United States Patent
Beirnaert et al.

(10) Patent No.: US 9,475,877 B2
(45) Date of Patent: *Oct. 25, 2016

(54) AMINO ACID SEQUENCES DIRECTED AGAINST RANK-L AND POLYPEPTIDES COMPRISING THE SAME FOR THE TREATMENT OF BONE DISEASES AND DISORDERS

(75) Inventors: Els Anna Alice Beirnaert, Bellem (BE); Sigrid Cornelis, St. Martens-Latem (BE); Hendricus Renerus Jacobus Mattheus Hoogenboom, Maastricht (NL)

(73) Assignee: Ablynx N.V., Zwijnaarde (BE)

( * ) Notice: Subject to any disclaimer, the term of this patent is extended or adjusted under 35 U.S.C. 154(b) by 264 days.

This patent is subject to a terminal disclaimer.

(21) Appl. No.: 12/558,032

(22) Filed: Sep. 11, 2009

(65) Prior Publication Data

US 2010/0104568 A1     Apr. 29, 2010

Related U.S. Application Data

(63) Continuation-in-part of application No. PCT/EP2008/056383, filed on May 23, 2008.

(60) Provisional application No. 60/939,929, filed on May 24, 2007, provisional application No. 61/024,256, filed on Jan. 29, 2008.

(51) Int. Cl.
| | |
|---|---|
| *C07K 16/18* | (2006.01) |
| *A61K 39/395* | (2006.01) |
| *C07K 16/28* | (2006.01) |
| *C07K 16/24* | (2006.01) |
| *A61K 39/00* | (2006.01) |

(52) U.S. Cl.
CPC ....... *C07K 16/2875* (2013.01); *A61K 39/3955* (2013.01); *C07K 16/24* (2013.01); *A61K 2039/505* (2013.01); *C07K 2317/22* (2013.01); *C07K 2317/24* (2013.01); *C07K 2317/31* (2013.01); *C07K 2317/569* (2013.01); *C07K 2317/76* (2013.01)

(58) Field of Classification Search
None
See application file for complete search history.

(56) References Cited

U.S. PATENT DOCUMENTS

| 8,623,361 B2 | 1/2014 | Beirnaert et al. |
| 2004/0033535 A1 | 2/2004 | Boyle et al. |
| 2004/0213788 A1 | 10/2004 | Sweet et al. |
| 2011/0002929 A1 | 1/2011 | Beirnaert et al. |
| 2014/0170167 A1 | 6/2014 | Holz et al. |
| 2014/0205601 A1 | 7/2014 | Beirnaert et al. |

FOREIGN PATENT DOCUMENTS

| CN | 101796072 A | 8/2010 |
| JP | 2004-520011 | 7/2004 |
| JP | 2008-540279 | 11/2008 |
| JP | 2009/515903 | 4/2009 |
| WO | WO 02/15846 A2 | 2/2002 |
| WO | WO 2004/041862 A2 | 5/2004 |
| WO | WO 2006/122786 A2 | 11/2006 |
| WO | WO 2006/122825 A2 | 11/2006 |
| WO | WO2006122787 | * 11/2006 |
| WO | WO 2007/042289 A2 | 4/2007 |
| WO | WO 2007/059136 A2 | 5/2007 |
| WO | WO 2008/142164 A2 | 11/2008 |
| WO | WO2009095235 | * 8/2009 |
| WO | WO 2010/097385 A1 | 9/2010 |
| WO | WO 2010/125187 A2 | 11/2010 |
| WO | WO 2011/026945 A1 | 3/2011 |

OTHER PUBLICATIONS

Rudikoff, Giusti, Cook, and Scharff. Single amino acid substitution altering antigen-binding specificity. Proceedings of the National Academy of Sciences, 1982. vol. 79, pp. 1979-1983.*

Mac Callum, Martin, and Thornton. Antibody antigen interations: contact analysis and binding site topography. Journal of Molecular Biology, 1996. vol. 262, pp. 732-745.*

De Pascalis, Iwahashi, Tamura, Padlan, Gonzales, Santos, Giuliano, Schuck, Schlom, and Kashmiri. Grafting of abbreviated complementarity determining regions containing specificity determining residues essential for ligand contact to engineer a less immunogenic humanized monoclonal antibody. Journal of Immunology, 2002. vol. 169, pp. 3076-3084.*

Casset, Roux, Mouchet, Bes, Chardes, Granier, Mani, Pugniere, Laune, Pau, Kaczorek, Lahana, and Rees. A peptide mimetic of an anti-CD4 monoclonal antibody by rational design. Biochemical and Biophysical Research Communications, 2003. vol. 307, pp. 198-205.*

Chen, Wiesmann, Fuh, Li, Christinger, Mc Kay, De Vos, and Lowman. Selection and analysis of an optimized anti-VEGF antibody: crystal structure of an affinity-matured Fab in complex with antigen. Journal of Molecular Biology, 1999. vol. 293, pp. 865-881.*

Wu, Nie, Huse, and Watkins. Humanization of a murine monoclonal antibody by simultaneous optimization of framework and CDR residues. Journal of Molecular Biology, 1999. vol. 294, pp. 151-162.*

(Continued)

*Primary Examiner* — Michael D Allen
(74) *Attorney, Agent, or Firm* — Wolf, Greenfield & Sacks, P.C.

(57) ABSTRACT

The present invention relates to amino acid sequences that are directed against RANK-L, as well as to compounds or constructs, and in particular proteins and polypeptides, that comprise or essentially consist of one or more such amino acid sequences. The invention also relates to nucleic acids encoding such amino acid sequences and polypeptides; to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes.

22 Claims, 39 Drawing Sheets

(56) References Cited

OTHER PUBLICATIONS

Vajdos, Adams, Breece, Presta, De Vos, and Sidhu. Comprehensive functional maps of the antigen binding site of an anti-ErbB2 antibody obtained with shotgun scanning mutagenesis. Journal of Molecular Biology, 2002. vol. 320, pp. 415-428.*
Holm, Jafari, and Sundstrom. Functional mapping and single chain construction of the anti-cytokeratin 8 monoclonal antibody TS1. Molecular Immunology, 2007. vol. 44, pp. 1075-1084.*
Granziero, Krajewski, Farness, Yuan, Courtney, Jackson, Peterson, and Vitiello. Adoptive immunotherapy prevents prostate cancer in a transgenic animal model. European Journal of Immunology, 1999. vol. 29, pages 1127-1138.*
Byers. What can randomized controlled trials tell us about nutrition and cancer prevention? CA Cancer Journal for Clinicians, 1999. vol. 49, pp. 353-361.*
Casset, Biochemical and Biophysical Research Communications, vol. 307, p. 198-205, 2003.*
MacCallum, Journal of Molecular Biology, vol. 262, p. 732-745, 1996.*
Rudikoff, Proceedings of the National Academy of Sciences, U.S.A., vol. 79, p. 1979-1983, 1982.*
Paul, Fundamental Immunology: Third Edition, p. 292-295, 1993.*
Vu, Molecular Immunology, vol. 34, No. 16-17, p. 1121-1131, 1997.*
Johnson and Wu, Antibody Engineering: Methods and Protocols, p. 11-25, 2004.*
Panka, Proceedings of the National Academy of Sciences, U.S.A., vol. 85, p. 3080-3084, 1988.*
Huang, The Journal of Biological Chemistry, vol. 272, No. 43, p. 27155-27159, 1997.*
Anderson, D. M. et al., "A homologue of the TNF receptor and its ligand enhance T-cell growth and dendritic-cell function," Nature Nov. 13, 1997; 390:175-179.
Coppieters, K. et al., "Formatted Anti-Tumor Necrosis Factor α VHH Proteins Derived From Camelids Show Superior Potency and Targeting to Inflamed Joints in a Murine Model of Collagen-Induced Arthritis," Arthritis & Rheumatism Jun. 2006; 54(6):1856-1866.
Holliger, P. et al., "Engineered antibody fragments and the rise of single domains," Nature Biotechnology Sep. 2005; 23(9):1126-1136.
Kostenuik, P. J., "Osteoprotegerin and RANKL regulate bone resorption, density, geometry and strength," Current Opinion in Pharmacology 2005; 5:618-625.
McClung, M. R. et al., "Denosumab in Postmenopausal Women with Low Bone Density," The New England Journal of Medicine Feb. 23, 2006; 354:821-831.
Roovers, R. C. et al., "Efficient inhibition of EGFR signaling and of tumour growth by antagonistic anti-EGFR Nanobodies," Cancer Immunol. Immunother. 2007; 56:303-317.
Silence, K. et al., "ALX-0081 Nanobody™, an Engineered Bivalent Anti-Thrombotic Drug Candidate with Improved Efficacy and Safety as Compared to the Marketed Drugs," Blood 2006; ASH Annual Meeting Abstracts 108: Abstract 896.
Beirnaert, E. et al. "Competitive pharmacological and pharmacodynamic profile of ALX-0141, a format-engineered Nanobody® targeting human RANKL" (poster), American Society for Bone and Mineral Research (ASBMR), 31st Annual Meeting, Denver, Colorado, Sep. 11-15, 2009.
Desmyter, A. et al., "Antigen Specificity and High Affinity Binding Provided by One Single Loop of a Camel Single-domain Antibody," The Journal of Biological Chemistry 2001; 276(28):26285-26290.
Garnero, P. et al., "Short-Term Effects of New Synthetic Conjugated Estrogens on Biochemical Markers of Bone Turnover," J Clin Pharmacol. Mar. 2002;42(3):290-6.
Muyldermans, S. et al., "Unique single-domain antigen binding fragments derived from naturally occurring camel heavy-chain antibodies," J. Mol. Recognit. 1999; 12:131-140.

Ohno, S. et al., "Antigen-binding specificities of antibodies are primarily determined by seven residues of $V_H$," Proc. Natl. Acad. Sci. USA 1985; 82:2945-2949.
Singer, M. S. et al., "NTx: A New Tool to Track and Treat Osteoporosis," Orthopedics Technology Spotlight; Medcompare™ http://www.medcompare.com/spotlight.asp?spotlightid=181 Accessed on Jun. 28, 2011, 2 pages.
Wesolowski, J. et al., "Single domain antibodies: promising experimental and therapeutic tools in infection and immunity," Med Microbiol Immunol 2009; 198:157-174.
Office Action for Application No. 12/599,892 dated Mar. 7, 2013.
Abdallah et al., Increased RANKL/OPG mRNA ratio in iliac bone biopsies from women with hip fractures. Calcif Tissue Int. Feb. 2005;76(2):90-7. Epub Nov. 18, 2004.
Bekker et al., A single-dose placebo-controlled study of AMG 162, a fully human monoclonal antibody to RANKL, in postmenopausal women. J Bone Miner Res. Jul. 2004;19(7):1059-66. Epub Mar. 1, 2004.
Bekker et al., The effect of a single dose of osteoprotegerin in postmenopausal women. J Bone Miner Res. Feb. 2001;16(2):348-60.
Bezerra et al., RANK, RANKL and osteoprotegerin in arthritic bone loss. Braz J Med Biol Res. Feb. 2005;38(2):161-70. Epub Feb. 15, 2005.
Body et al., A phase I study of AMGN-0007, a recombinant osteoprotegerin construct, in patients with multiple myeloma or breast carcinoma related bone metastases. Cancer. Feb. 1, 2003;97(3 Suppl):887-92.
Brown et al., Opg, RANKL, and RANK in cancer metastasis: expression and regulation. Cancer Treat Res. 2004;118:149-72.
Campagnuolo et al., Kinetics of bone protection by recombinant osteoprotegerin therapy in Lewis rats with adjuvant arthritis. Arthritis Rheum. Jul. 2002;46(7):1926-36.
Crotti et al., Receptor activator NF-kappaB ligand (RANKL) expression in synovial tissue from patients with rheumatoid arthritis, spondyloarthropathy, osteoarthritis, and from normal patients: semiquantitative and quantitative analysis. Ann Rheum Dis. Dec. 2002;61(12):1047-54.
Eghbali-Fatourechi et al., Role of RANK ligand in mediating increased bone resorption in early postmenopausal women. J Clin Invest. Apr. 2003;111(8):1221-30.
Gibbs, Nanobodies. Scientific American. Aug. 2005:79-83.
Hamers-Casterman et al., Naturally occurring antibodies devoid of light chains. Nature. Jun. 3, 1993;363(6428):446-8.
Harmsen et al., Llama heavy-chain V regions consist of at least four distinct subfamilies revealing novel sequence features. Mol Immunol. Aug. 2000;37(10):579-90.
Holt et al., Domain antibodies: proteins for therapy. Trends Biotechnol. Nov. 2003;21(11):484-90.
Hsu et al., Tumor necrosis factor receptor family member RANK mediates osteoclast differentiation and activation induced by osteoprotegerin ligand. Proc Natl Acad Sci U S A. Mar. 30, 1999;96(7):3540-5.
Jespers et al., Crystal structure of HEL4, a soluble, refoldable human V(H) single domain with a germ-line scaffold. J Mol Biol. Apr. 2, 2004;337(4):893-903.
Johnell et al., Predictive value of BMD for hip and other fractures. J Bone Miner Res. Jul. 2005;20(7):1185-94. Epub Mar. 7, 2005. Erratum in: J Bone Miner Res. May 2007;22(5):774.
Jones et al., Role of RANKL and RANK in bone loss and arthritis. Ann Rheum Dis. Nov. 2002;61 Suppl 2:ii32-9.
Khosla, Minireview: the OPG/RANKL/RANK system. Endocrinology. Dec. 2001;142(12):5050-5.
Kong et al., OPGL is a key regulator of osteoclastogenesis, lymphocyte development and lymph-node organogenesis. Nature. Jan. 28, 1999;397(6717):315-23.
Lacey et al., Osteoprotegerin ligand is a cytokine that regulates osteoclast differentiation and activation. Cell. Apr. 17, 1998;93(2):165-76.
Lamminmaki et al., Crystal structure of a recombinant anti estradiol Fab fragment in complex with 17beta-estradiol. J Biol Chem. Sep. 28, 2001;276(39):36687-94. Epub Jul. 12, 2001.

(56) References Cited

OTHER PUBLICATIONS

Lewiecki, RANK ligand inhibition with denosumab for the management of osteoporosis. Expert Opin Biol Ther. Oct. 2006;6(10):1041-50.

Li et al., RANK is the intrinsic hematopoietic cell surface receptor that controls osteoclastogenesis and regulation of bone mass and calcium metabolism. Proc Natl Acad Sci U S A. Feb. 15, 2000;97(4):1566-71.

Lubberts et al., Increase in expression of receptor activator of nuclear factor kappaB at sites of bone erosion correlates with progression of inflammation in evolving collagen-induced arthritis. Arthritis Rheum. Nov. 2002;46(11):3055-64.

Lum et al., Evidence for a role of a tumor necrosis factor-alpha (TNF-alpha)-converting enzyme-like protease in shedding of TRANCE, a TNF family member involved in osteoclastogenesis and dendritic cell survival. J Biol Chem. May 7, 1999;274(19):13613-8.

McClung, Inhibition of RANKL as a treatment for osteoporosis: preclinical and early clinical studies. Curr Osteoporos Rep. Mar. 2006;4(1):28-33.

Muyldermans, Single domain camel antibodies: current status. Reviews Molecular Biotechnology. Jun. 2001;74(4):277-302.

Nagai et al., Cancer cells responsible for humoral hypercalcemia express mRNA encoding a secreted form of ODF/TRANCE that induces osteoclast formation. Biochem Biophys Res Commun. Mar. 16, 2000;269(2):532-6.

Niida et al., Gamma-glutamyltranspeptidase stimulates receptor activator of nuclear factor-kappaB ligand expression independent of its enzymatic activity and serves as a pathological bone-resorbing factor. J Biol Chem. Feb. 13, 2004;279(7):5752-6. Epub Nov. 21, 2003.

Okada et al., Bone marrow metastatic myeloma cells promote osteoclastogenesis through RANKL on endothelial cells. Clin Exp Metastasis. 2003;20(7):639-46.

Padlan et al., Structure of an antibody-antigen complex: crystal structure of the HyHEL-10 Fab-lysozyme complex. Proc Natl Acad Sci U S A. Aug. 1989;86(15):5938-42.

Queen et al., A humanized antibody that binds to the interleukin 2 receptor. Proc Natl Acad Sci U S A. Dec. 1989;86(24):10029-33.

Reddy, Etiology of Paget's disease and osteoclast abnormalities. J Cell Biochem. Nov. 1, 2004;93(4):688-96.

Riechmann et al., Single domain antibodies: comparison of camel VH and camelised human VH domains. J Immunol Methods. Dec. 10, 1999;231(1-2):25-38.

Roitt et al., Molecules which recognize antigen. Immunology. 1989; $2^{nd}$ ed:5.1-5.11.

Simonet et al., Osteoprotegerin: a novel secreted protein involved in the regulation of bone density. Cell. Apr. 18, 1997;89(2):309-19.

Singer et al., Genes and Genomes. 1998;1:131-137, 256-257.

Stilgren et al., Skeletal changes in osteoprotegerin and receptor activator of nuclear factor-kappab ligand mRNA levels in primary hyperparathyroidism: effect of parathyroidectomy and association with bone metabolism. Bone. Jul. 2004;35(1):256-65.

Tsangari et al., Increased expression of IL-6 and RANK mRNA in human trabecular bone from fragility fracture of the femoral neck. Bone. Jul. 2004;35(1):334-42.

Ward et al., Binding activities of a repertoire of single immunoglobulin variable domains secreted from *Escherichia coli*. Nature. Oct. 12, 1989;341(6242):544-6.

Wolfson, Ablynx makes Nanobodies from llama bodies. Chem Biol. Dec. 2006;13(12):1243-4.

Wong et al., TRANCE is a novel ligand of the tumor necrosis factor receptor family that activates c-Jun N-terminal kinase in T cells. J Biol Chem. Oct. 3, 1997;272(40):25190-4.

Yasuda et al., Osteoclast differentiation factor is a ligand for osteoprotegerin/osteoclastogenesis-inhibitory factor and is identical to TRANCE/RANKL. Proc Natl Acad Sci U S A. Mar. 31, 1998;95(7):3597-602.

[No Author Listed], Press Release Ablynx reports positive phase I data for its anti-RANKL Nanobody—Ghent, Belgium, Sep. 20, 2010.

[Not Author Listed] Press Release Ablynx provides update on its ongoing phase I study for ALX-0141—Ghent, Belgium. Jan. 9, 2011.

Baron et al., Denosumab and bisphosphonates: different mechanisms of action and effects. Bone. Apr. 1, 2011;48(4):677-92. doi: 10.1016/j.bone.2010.11.020. Epub Dec. 9, 2010.

Bridgeman et al., Denosumab for the reduction of bone loss in postmenopausal osteoporosis: a review. Clin Ther. Nov. 2011;33(11):1547-59. doi: 10.1016/j.clinthera.2011.10.008.

Lewiecki, Treatment of osteoporosis with denosumab. Maturitas. Jun. 2010;66(2):182-6. doi: 10.1016/j.maturitas.2010.02.008. Epub Mar. 16, 2010.

Martin, Protein Sequence and Structure Analysis of Antibody Variable Domains. Antibody Eng. 2010;2:33-51.

Miller, Denosumab: anti-RANKL antibody. Curr Osteoporos Rep. Mar. 2009;7(1):18-22.

Peterson et al., A PK/PD model developed in cynomolgus monkeys predicts concentrations and effects of AMG 162, a fully human monoclonal antibody against RANKL, in healthy postmenopausal women. Annual Meeting AAPS, Baltimore, MD. Nov. 7-11, 2004.

Sugimoto, [Anti-RANKL monoclonal antibody Denosumab (AMG162)]. Clin Calcium. Jan. 2011;21(1):46-51. doi: CliCa11014651. Abstract only.

Sugimoto, [Osteoporosis treatment by anti-RANKL antibody]. Clin Calcium. Aug. 2011;21(8):1209-15. doi: CliCa110812091215. Abstract only.

Van De Wetering De Rooij et al., Safety, pharmacokinetics and efficacy of anti-RANKL Nanobody ALX-0141 in healthy postmenopausal women. Abstract EULAR conference: May 25-28, 2011.

Paul, Fv structure and diversity in three dimensions. Fundamental immunology, 3rd Edition, 1993:292-295.

Tamura et al., Structural correlates of an anticarcinoma antibody: identification of specificity-determining residues (SDRs) and development of a minimally immunogenic antibody variant by retention of SDRs only. J Immunol. Feb. 1, 2000;164(3):1432-41.

Lefranc, M.-P. et al., IMGT unique numbering for immunoglobulin and T cell receptor variable domains and Ig superfamily V-like domains. Dev Comp Immunol. Jan. 2003;27(1):55-77.

\* cited by examiner

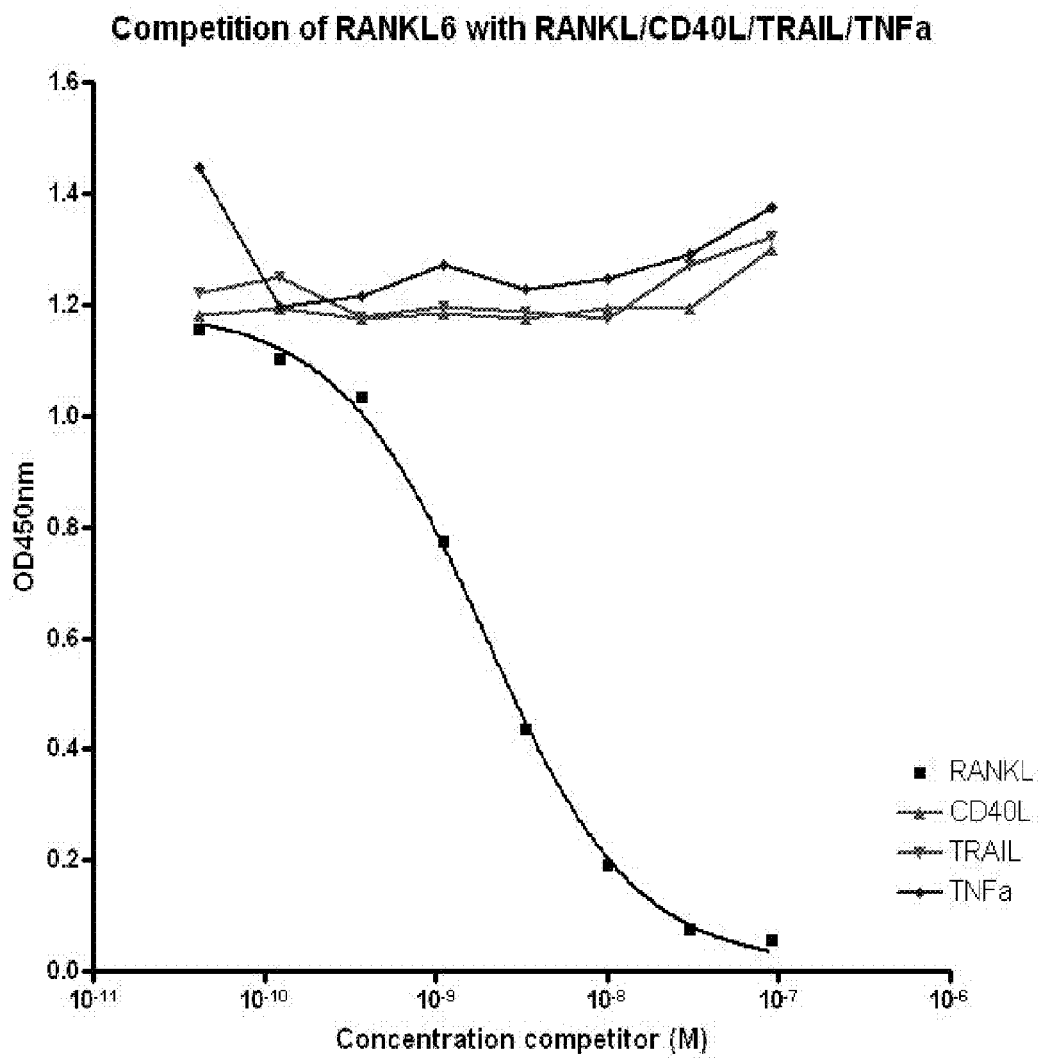
Figure 1-A

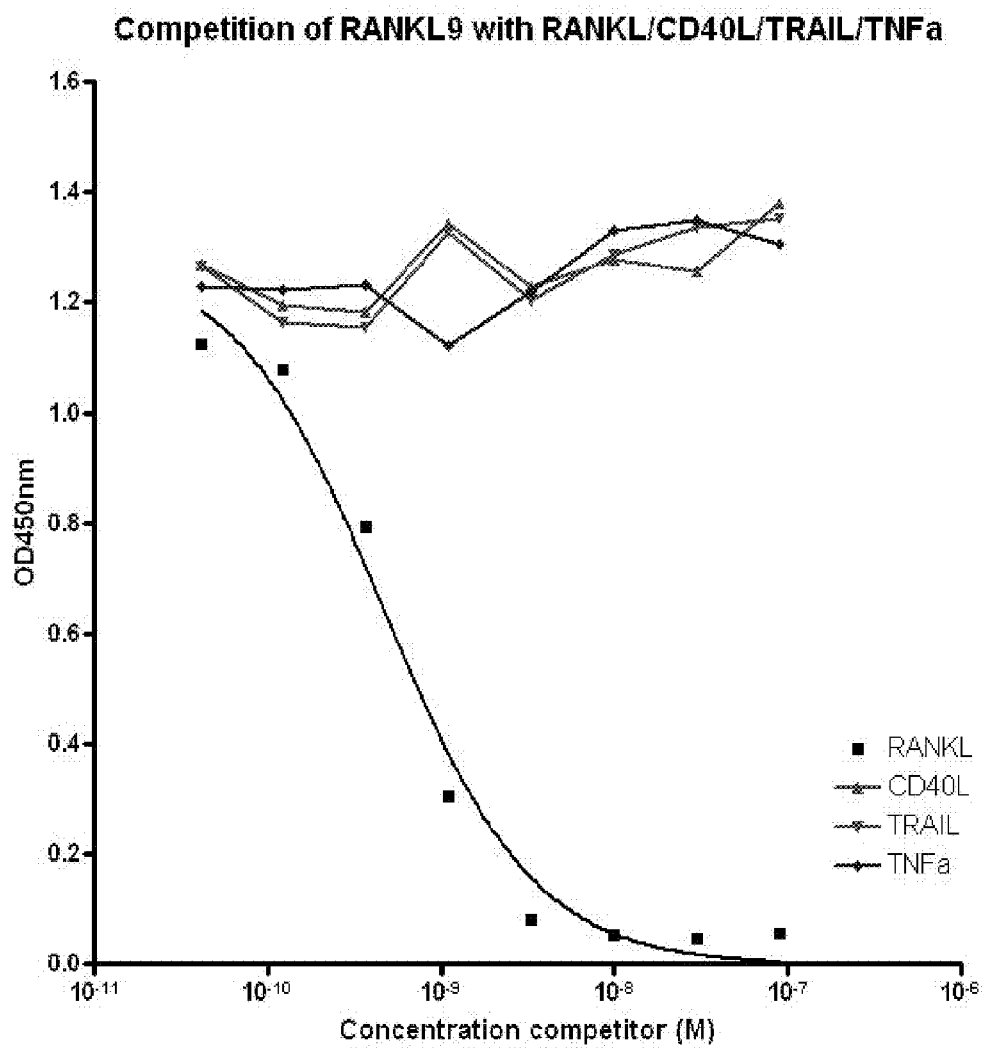
Figure 1-B

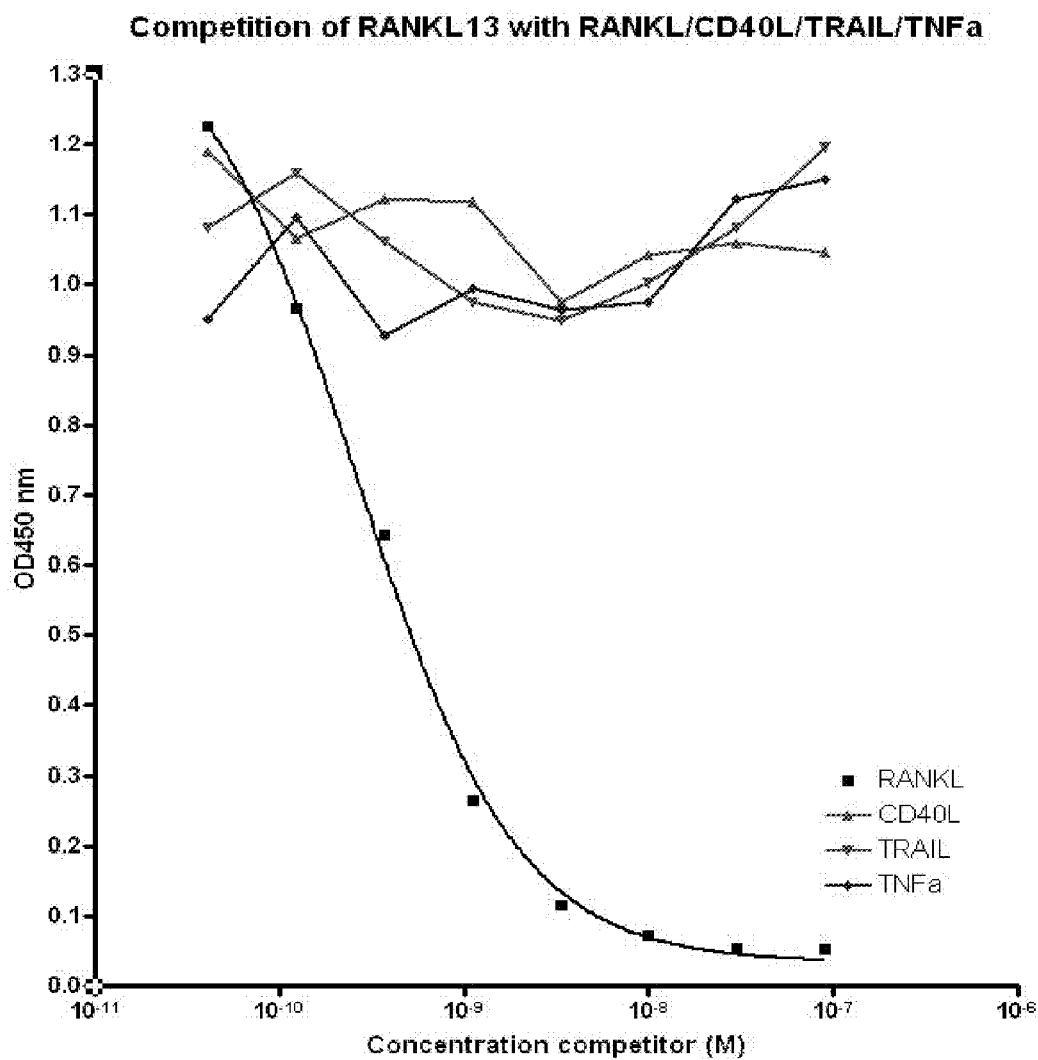
Figure 1-C

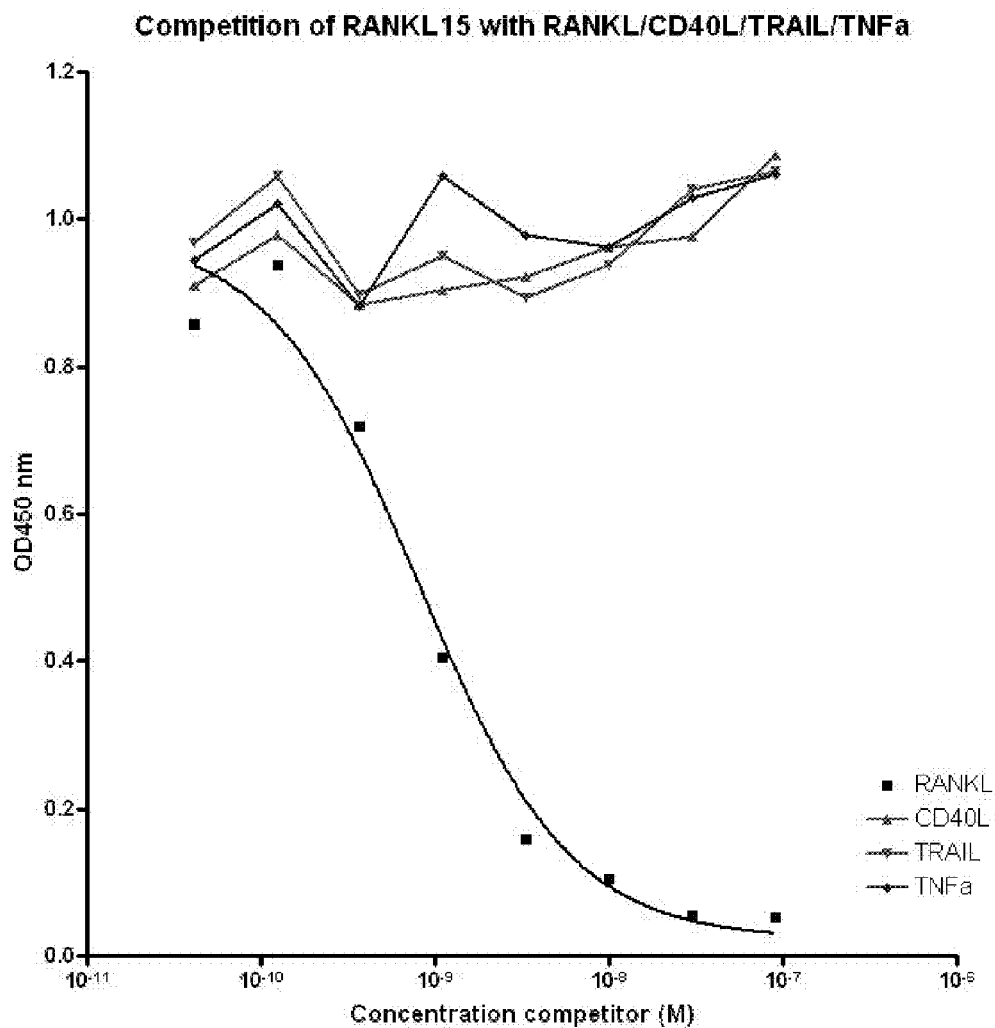
Figure 1-D

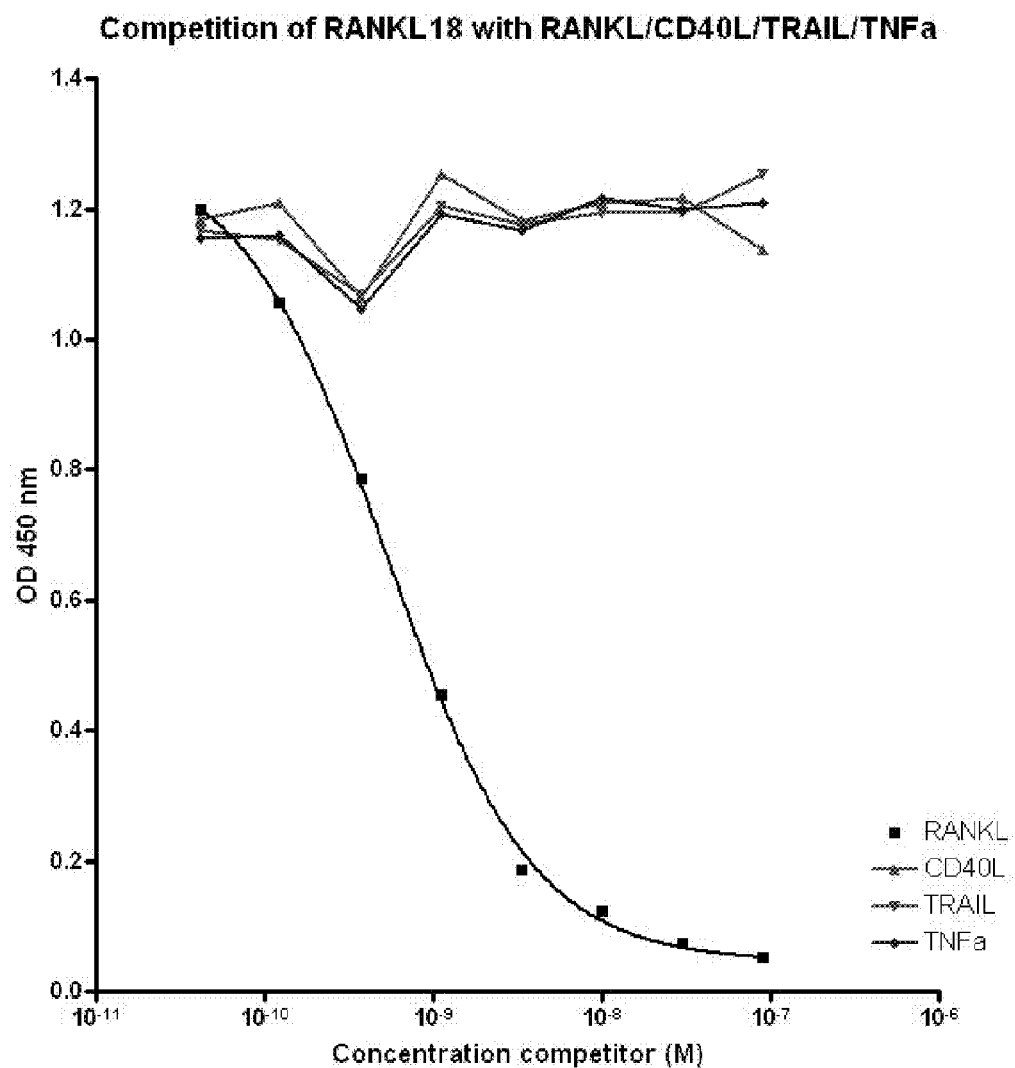
Figure 1-E

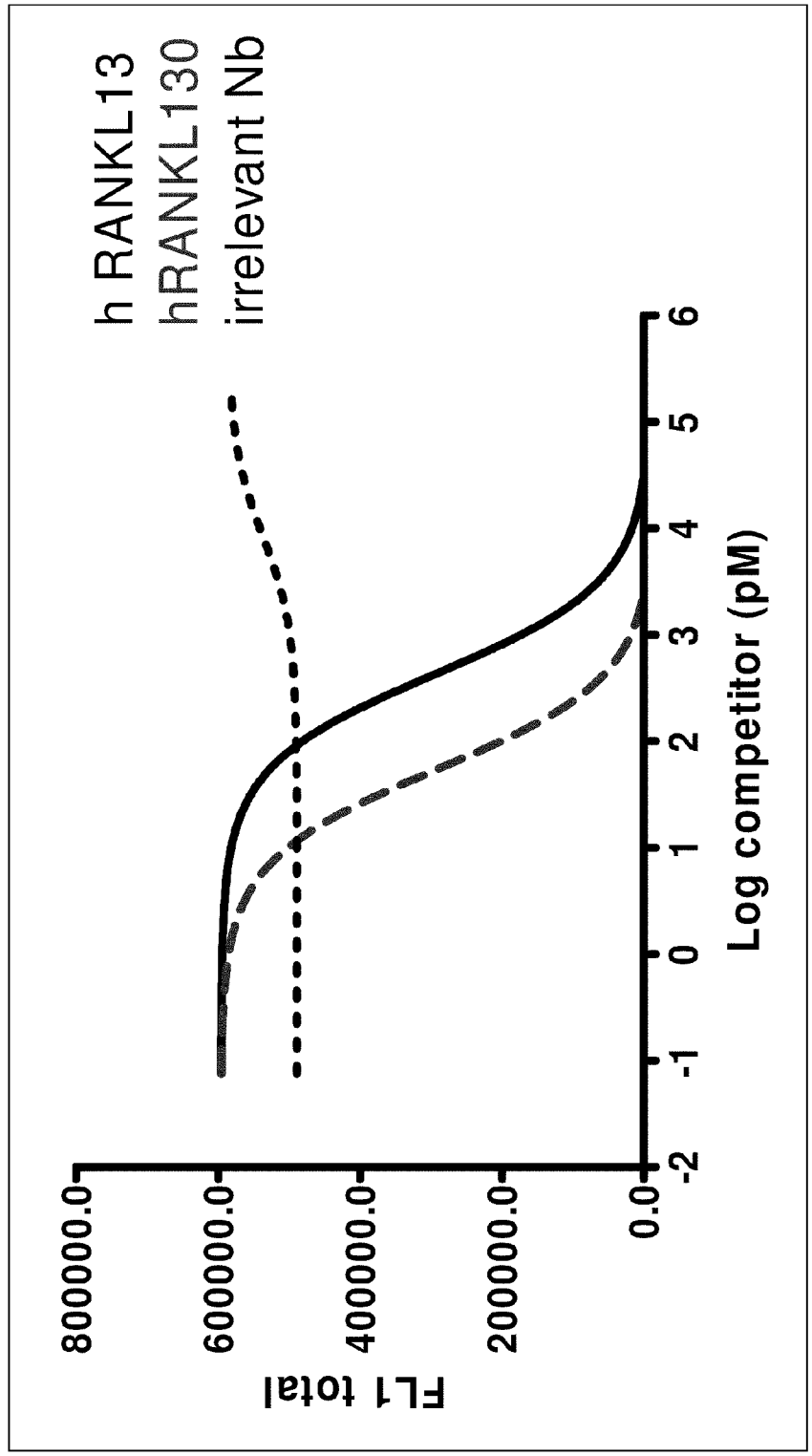
Figure 2-A

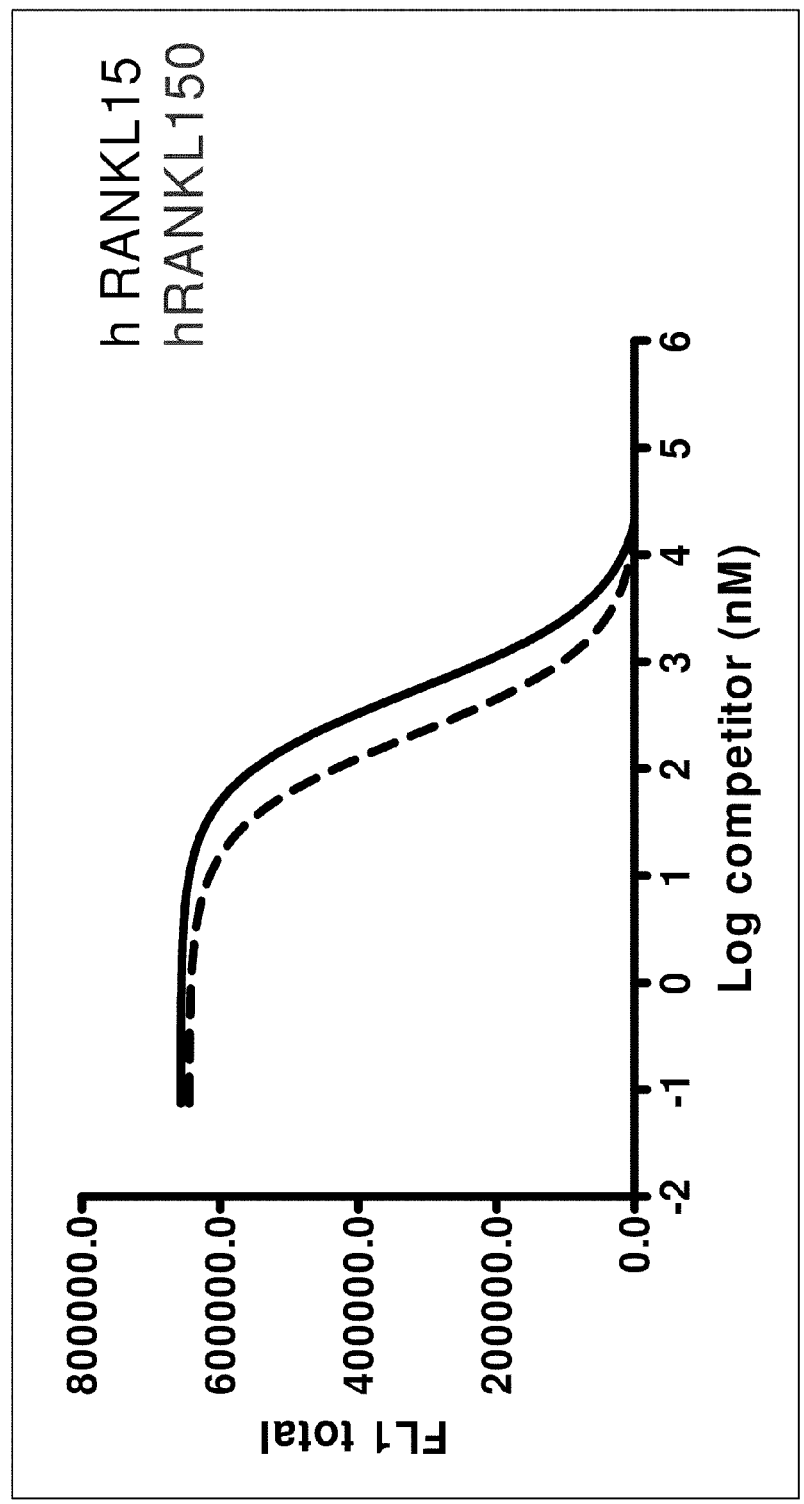
Figure 2-B

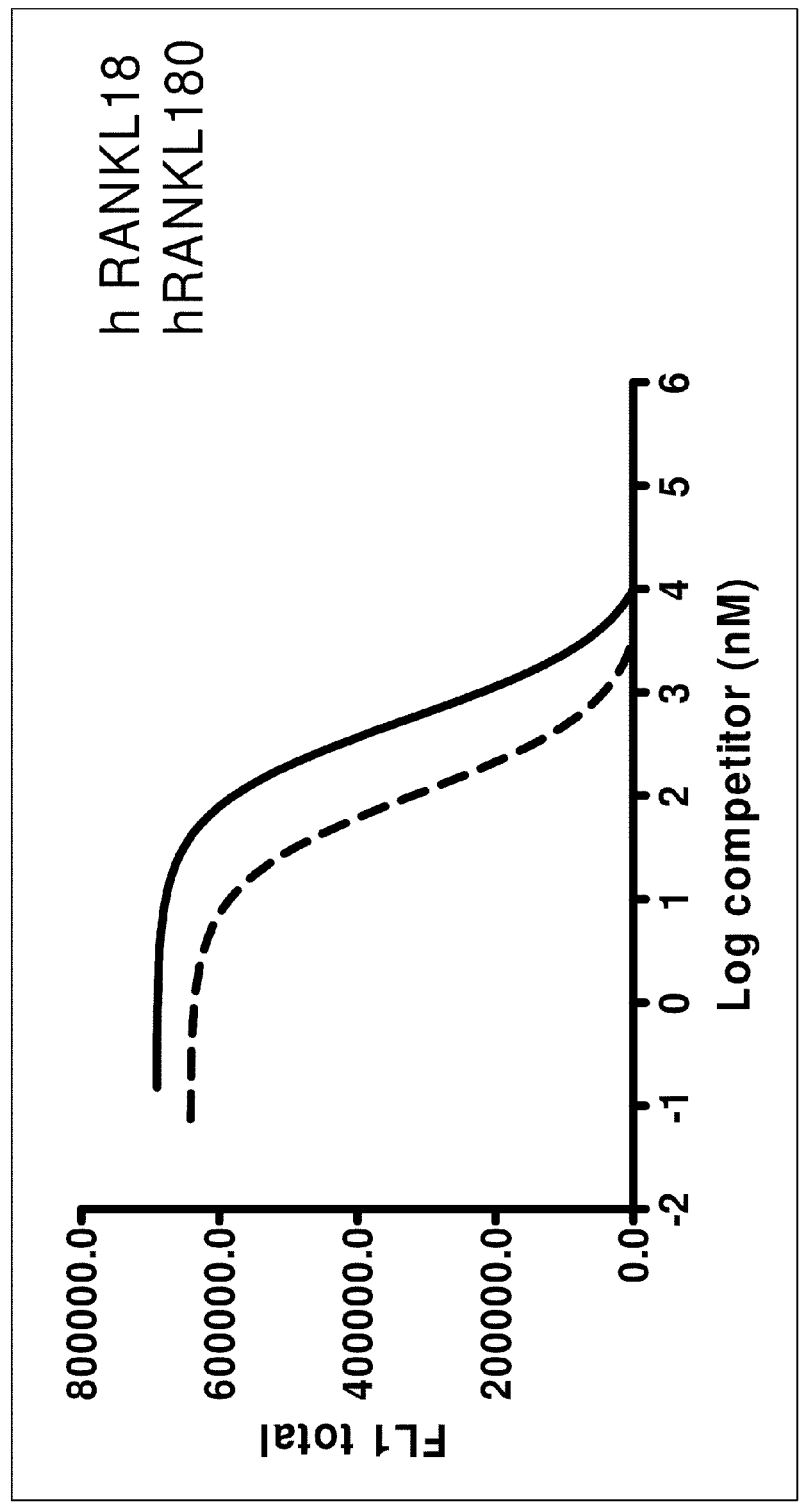
Figure 2-C

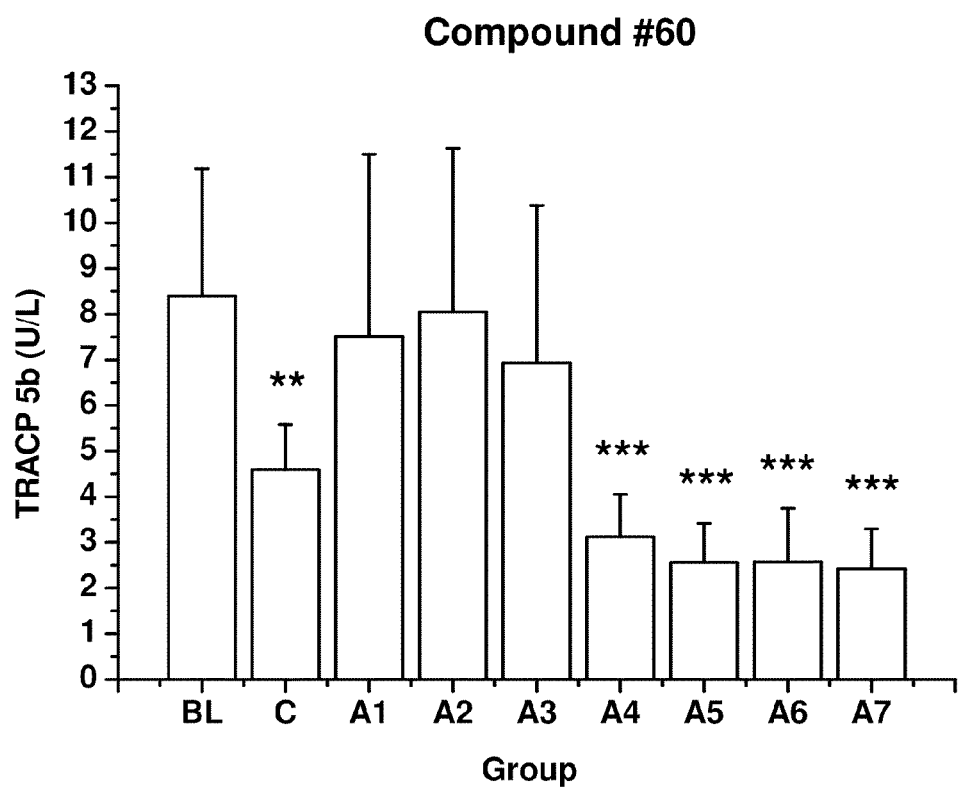
Figure 3-A

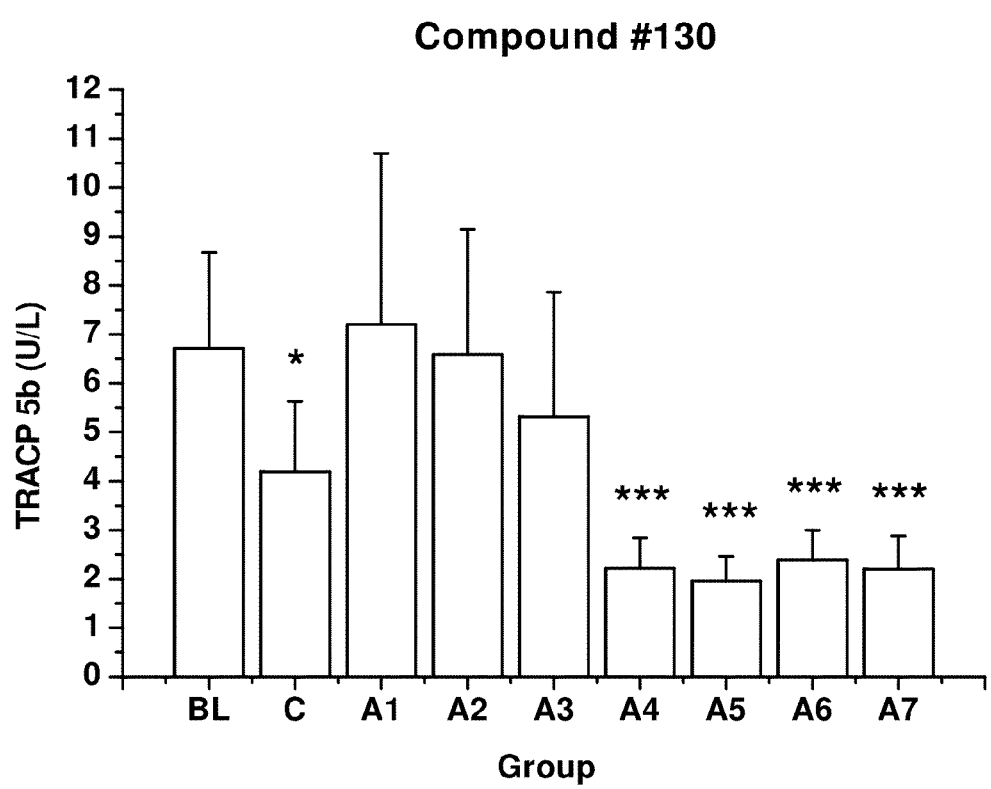
Figure 3-B

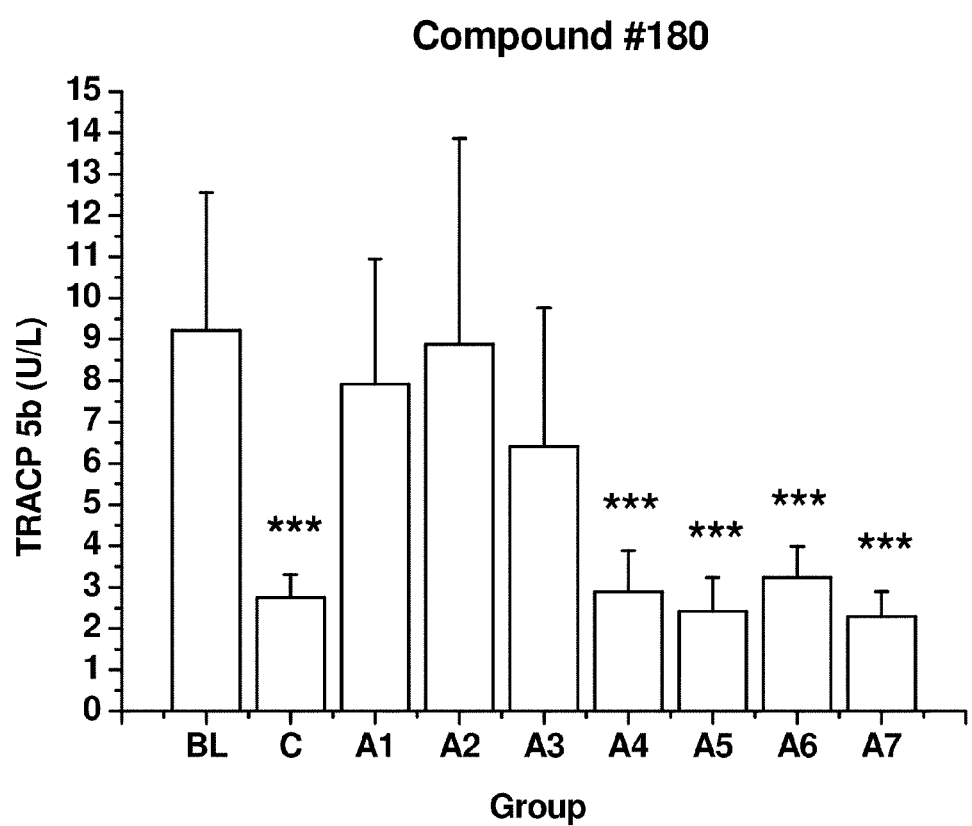
Figure 3-C

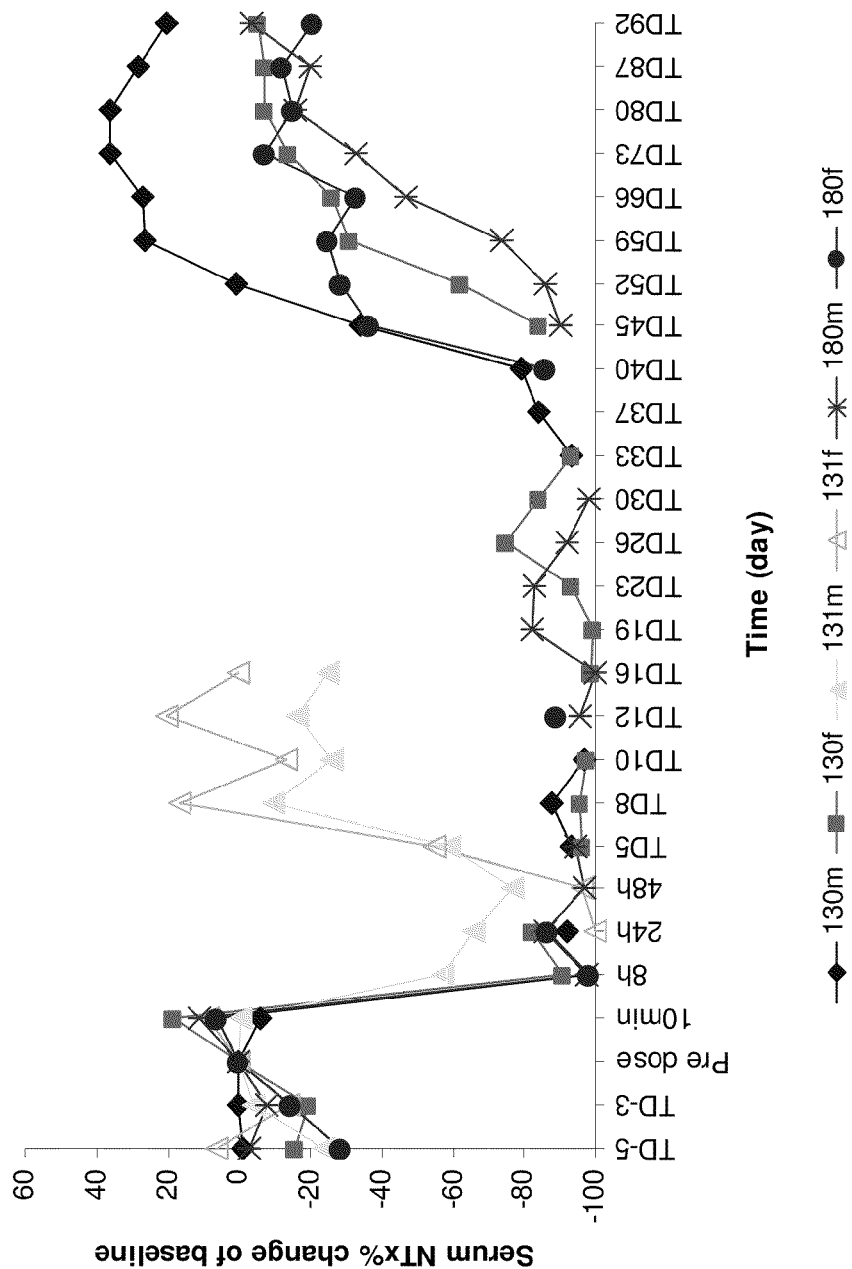
Figure 4-A

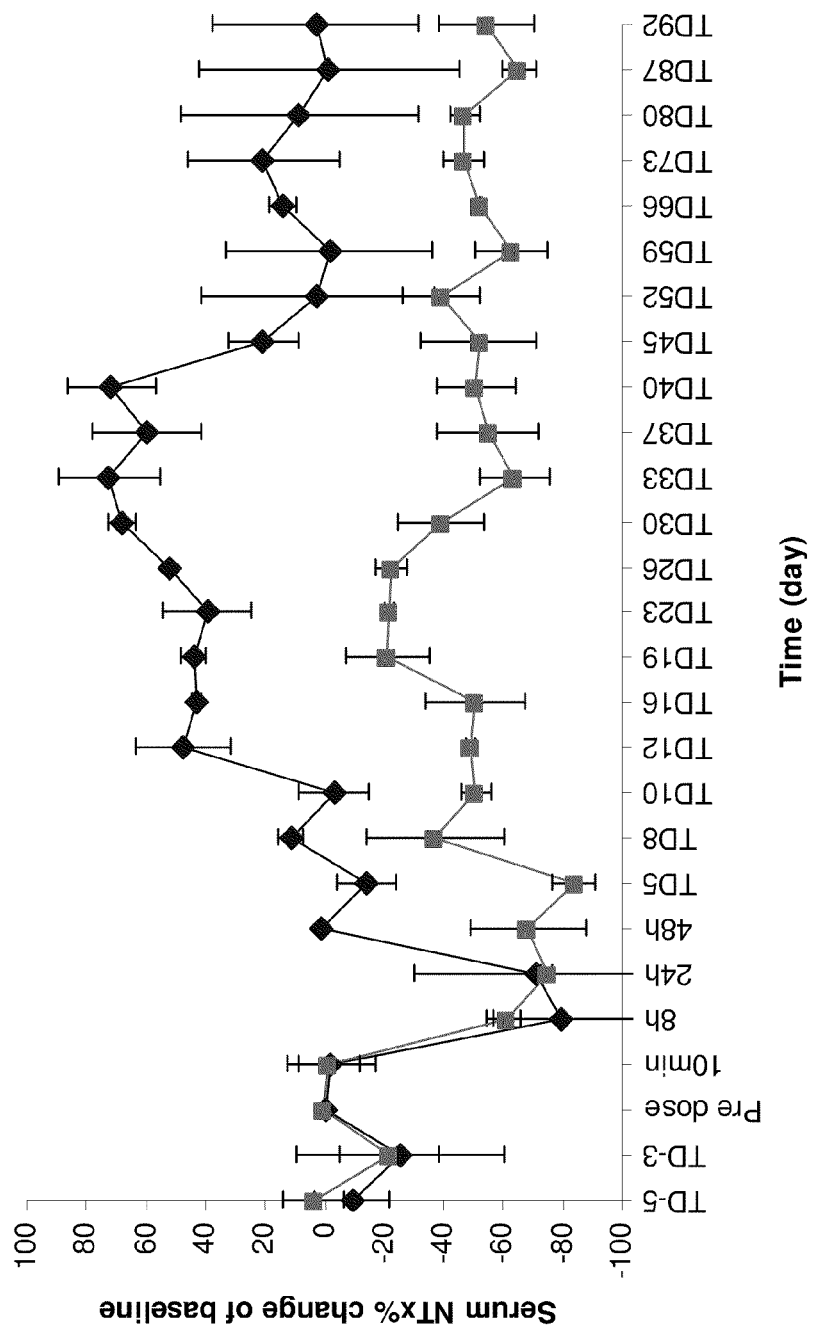
Figure 4-B

```
RANKL13WT      EVQLVESGGGLVQAGGSLRLSCAASGRTFRSYPMGWFRQAPGKEREFVASTTGSGGSTYYADSVKG
RANKL13hum5    EVQLVESGGGLVQPGGGSLRLSCAASGFTFSSYPMGWFRQAPGKGREFVSSITGSGGSTYYADSVKG
               EVQL+ESGGGLVQPGGSLR+SCAASGFTFSSY M  RQAPGKG E+VS+I-GSGGS-TYADSVKG
VH3-23 (DP47)  EVQLLESGGGLVQPGGSLRLSCAASGFTFSSYAMSWVRQAPGKGLEWVSAISGSGGSTYYADSVKG RANKL13WT      RFTISRDNAKNTVYLQMNSLRPEDTAVYSCAAYIRPDTYLSRDYRKYDYWGQGTQVTVSS  (SEQ ID NO: 572)
RANKL13hum5    RFTISRDNAKNTLYLQMNSLRPEDTAVYYCAAYIRPDTYLSRDYRKYDYWGQGTLVTVSS  (SEQ ID NO: 755)
               RFTISRDN+KNTLYLQMNSLR EDTAVYYCA
VH3-23 (DP47)  RFTISRDNSKNTLYLQMNSLRAEDTAVYYCAR............WGQGTLVTVSS       (SEQ ID NO: 763-4)
```

Figure 6

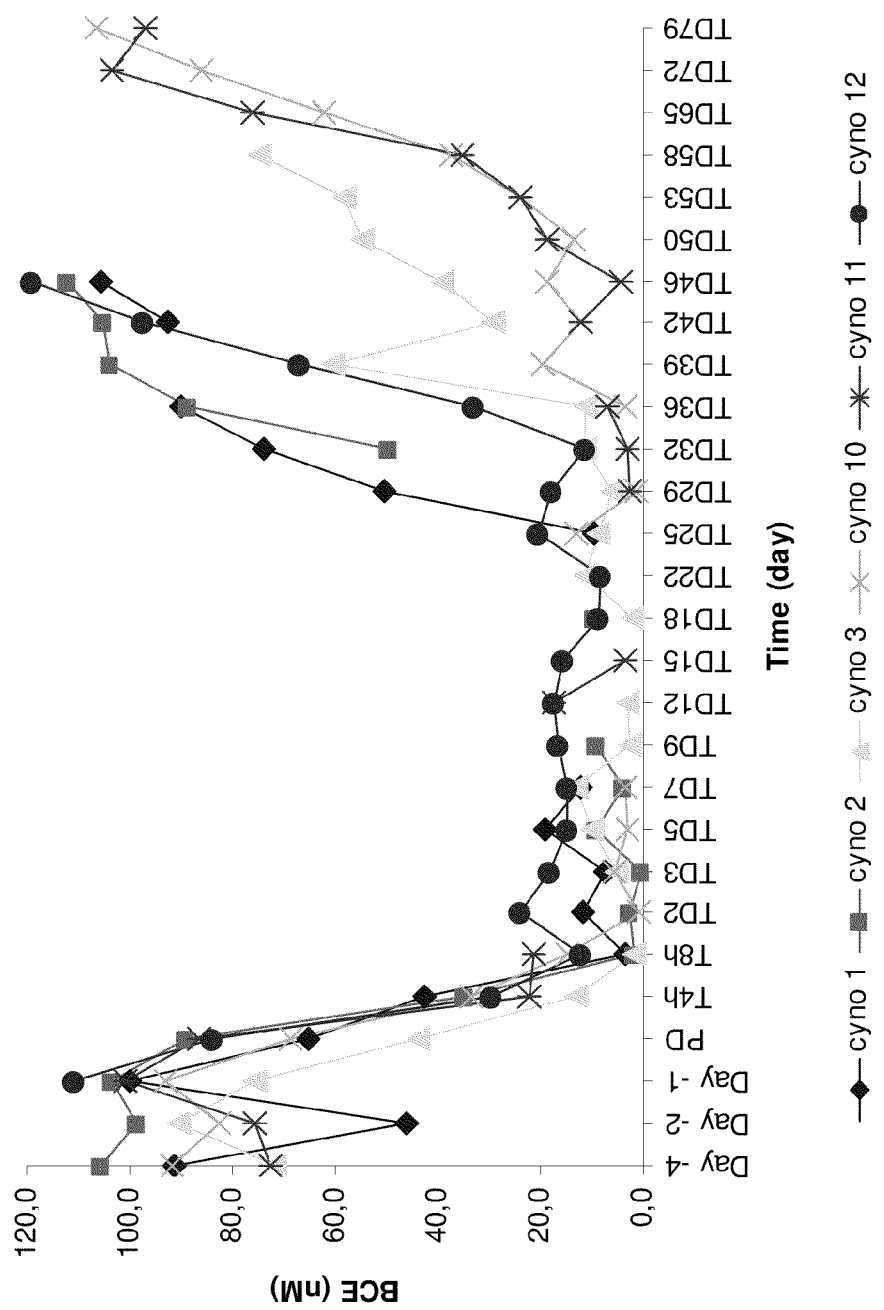
Figure 15-A

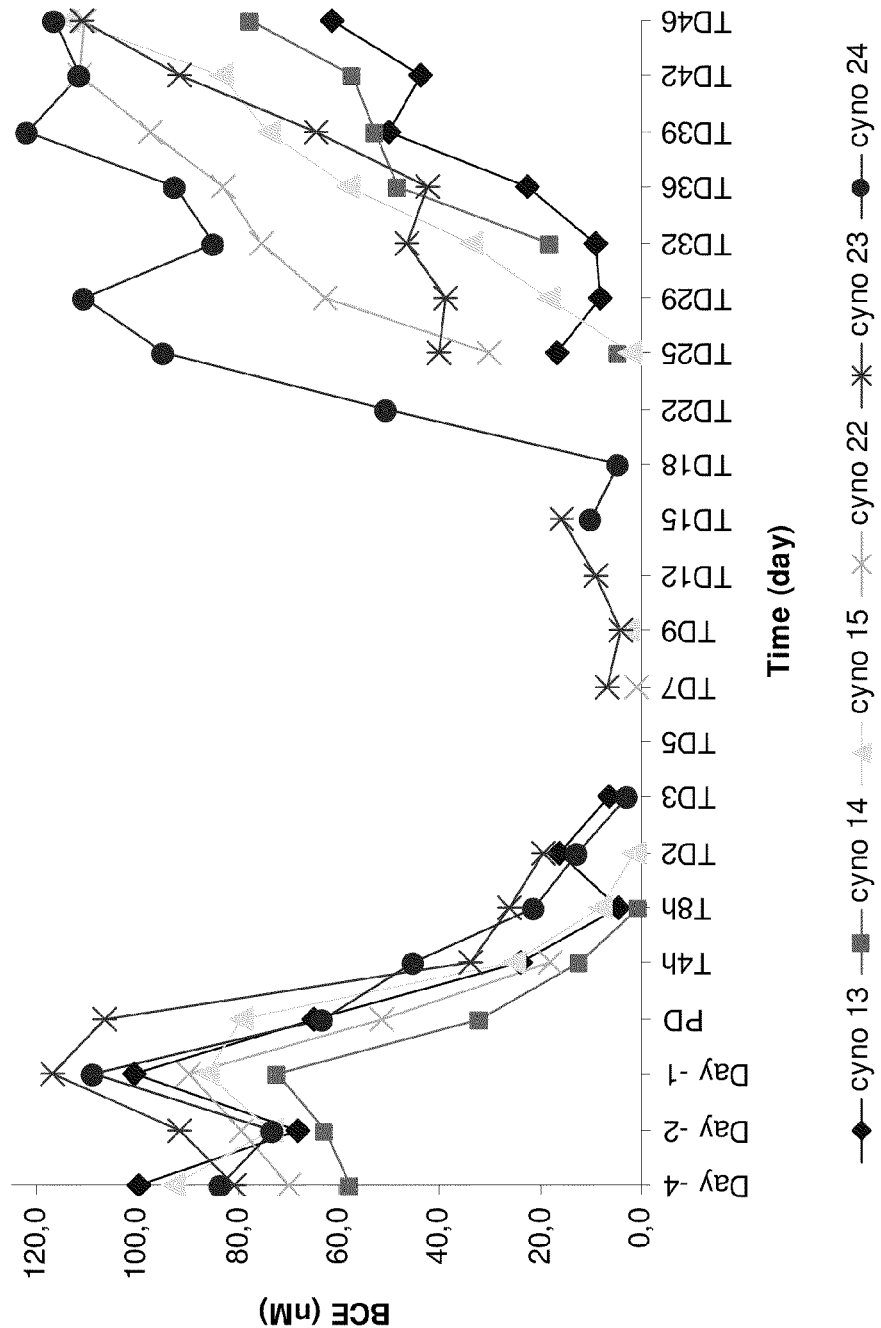
Figure 15-B

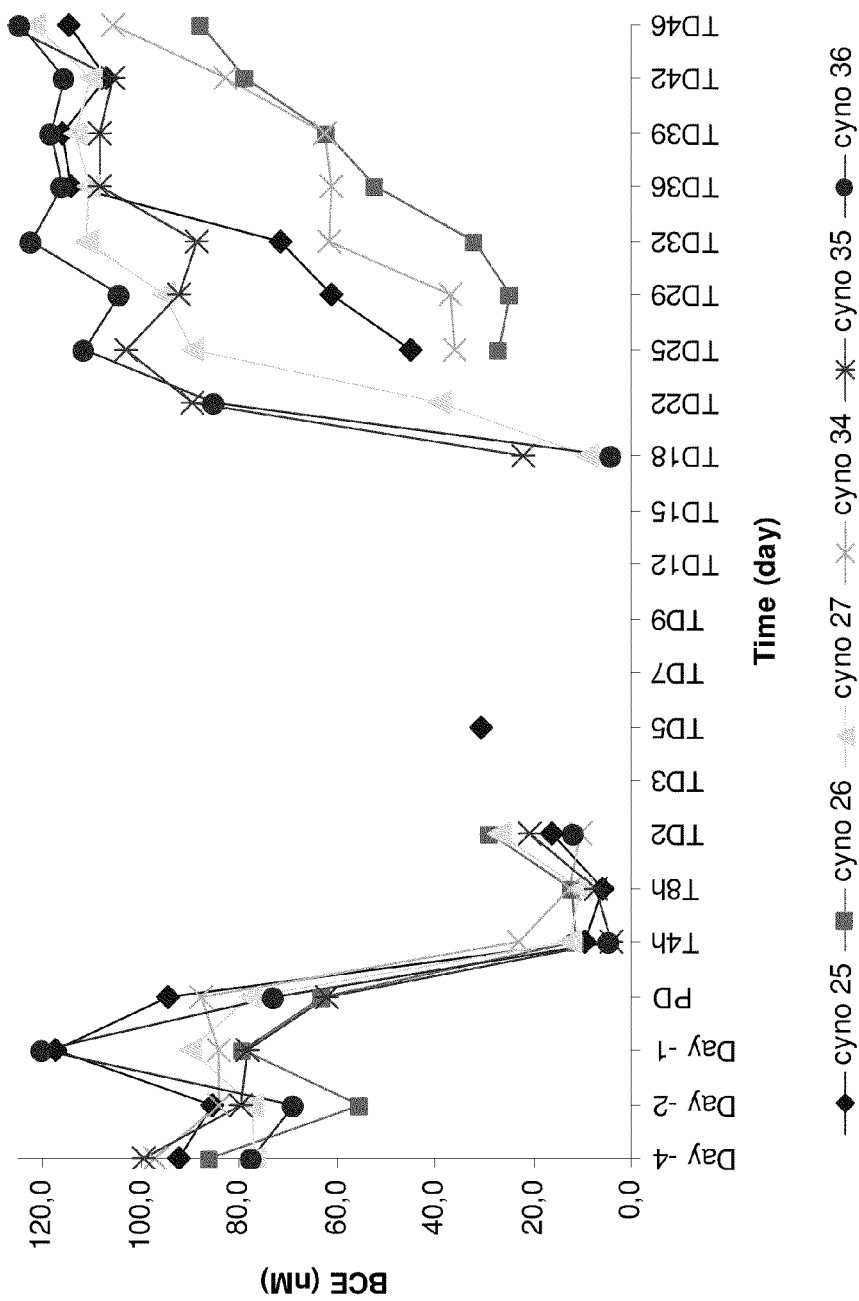
Figure 15-C

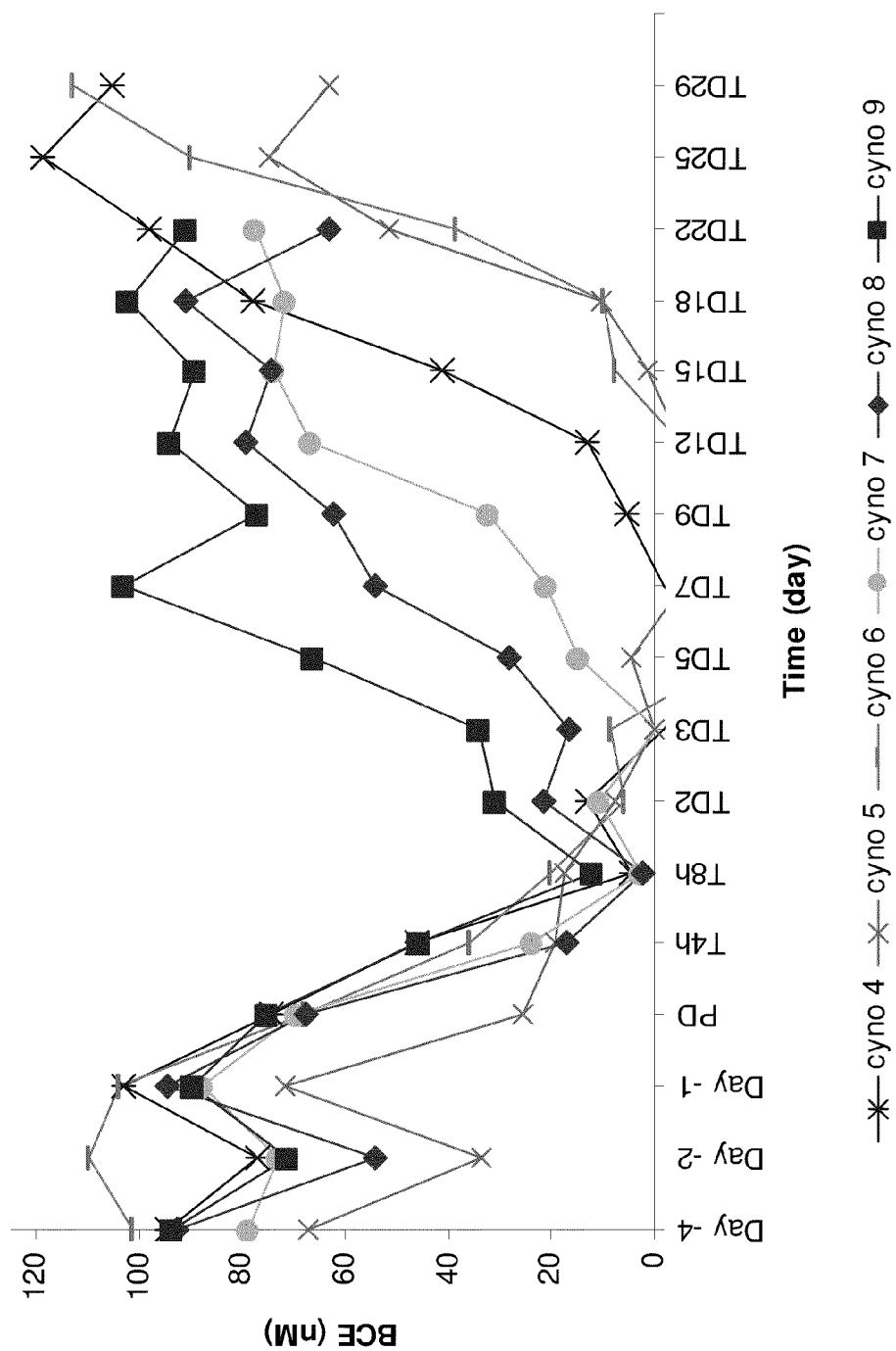
Figure 16-A

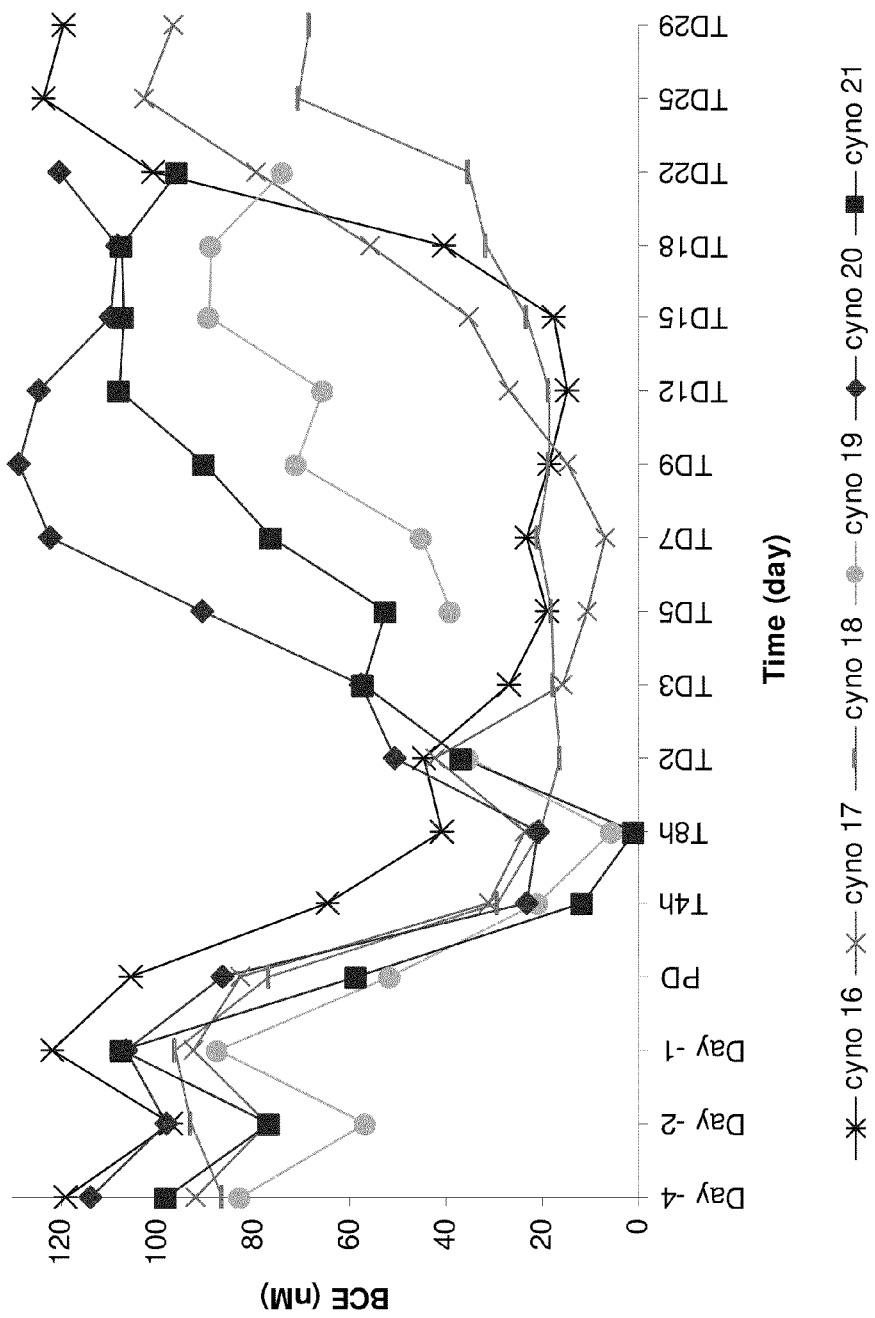
Figure 16-B

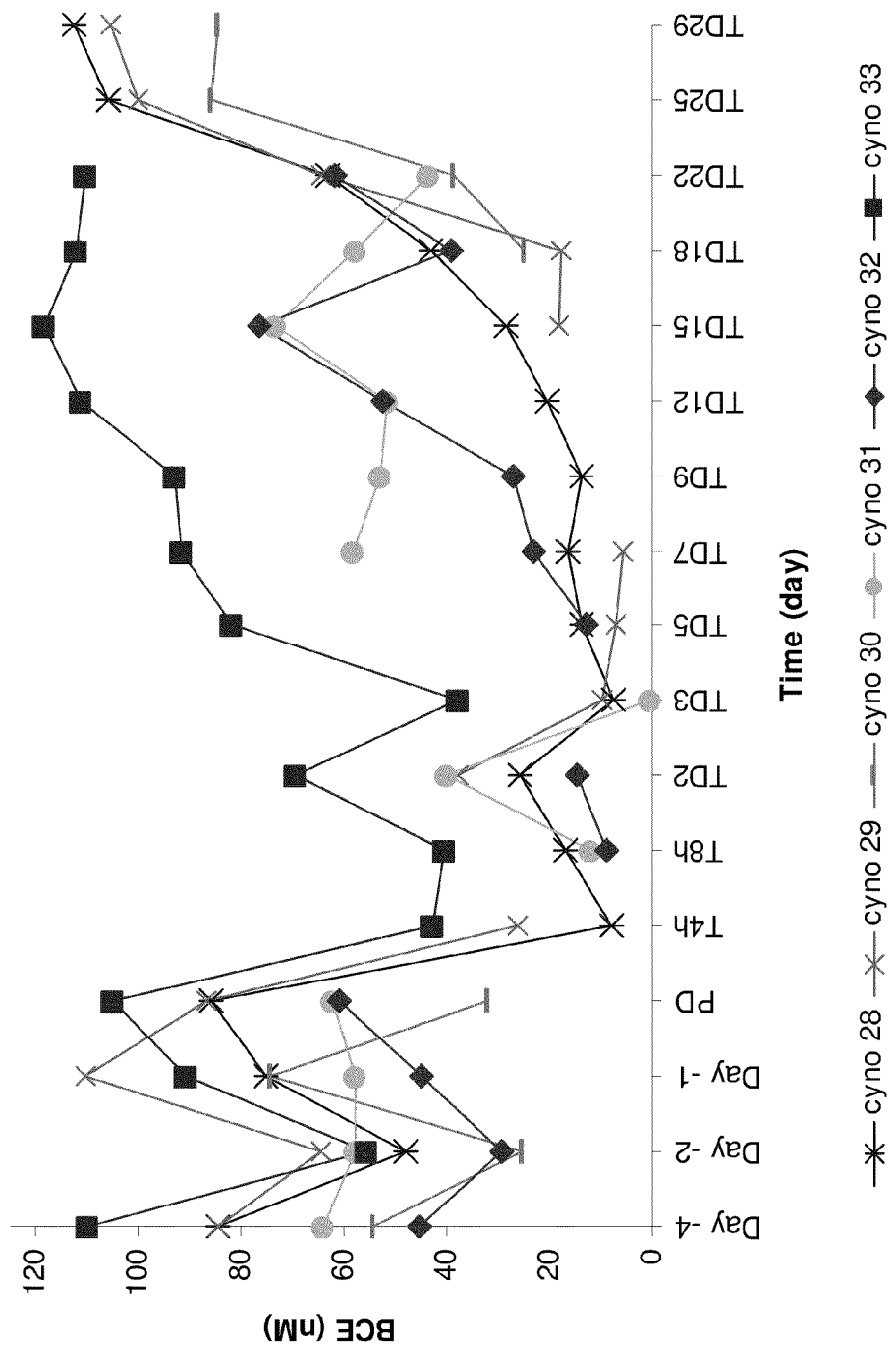
Figure 16-C

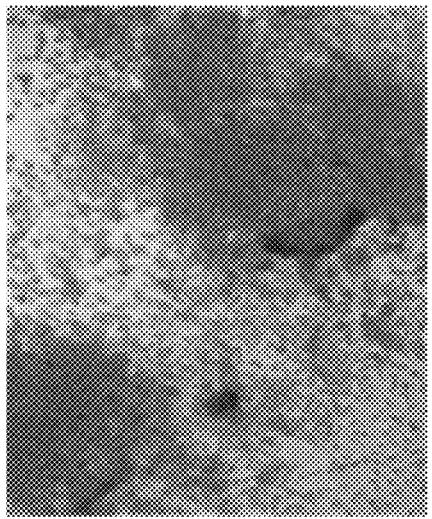
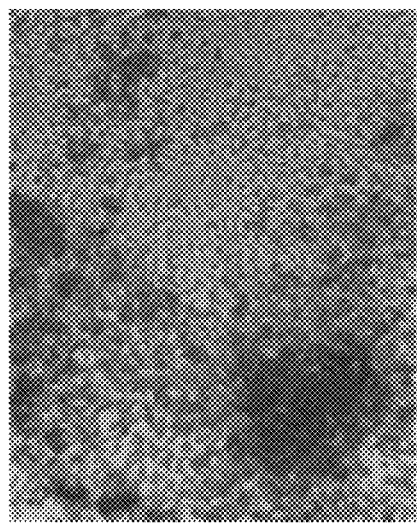
Figure 23

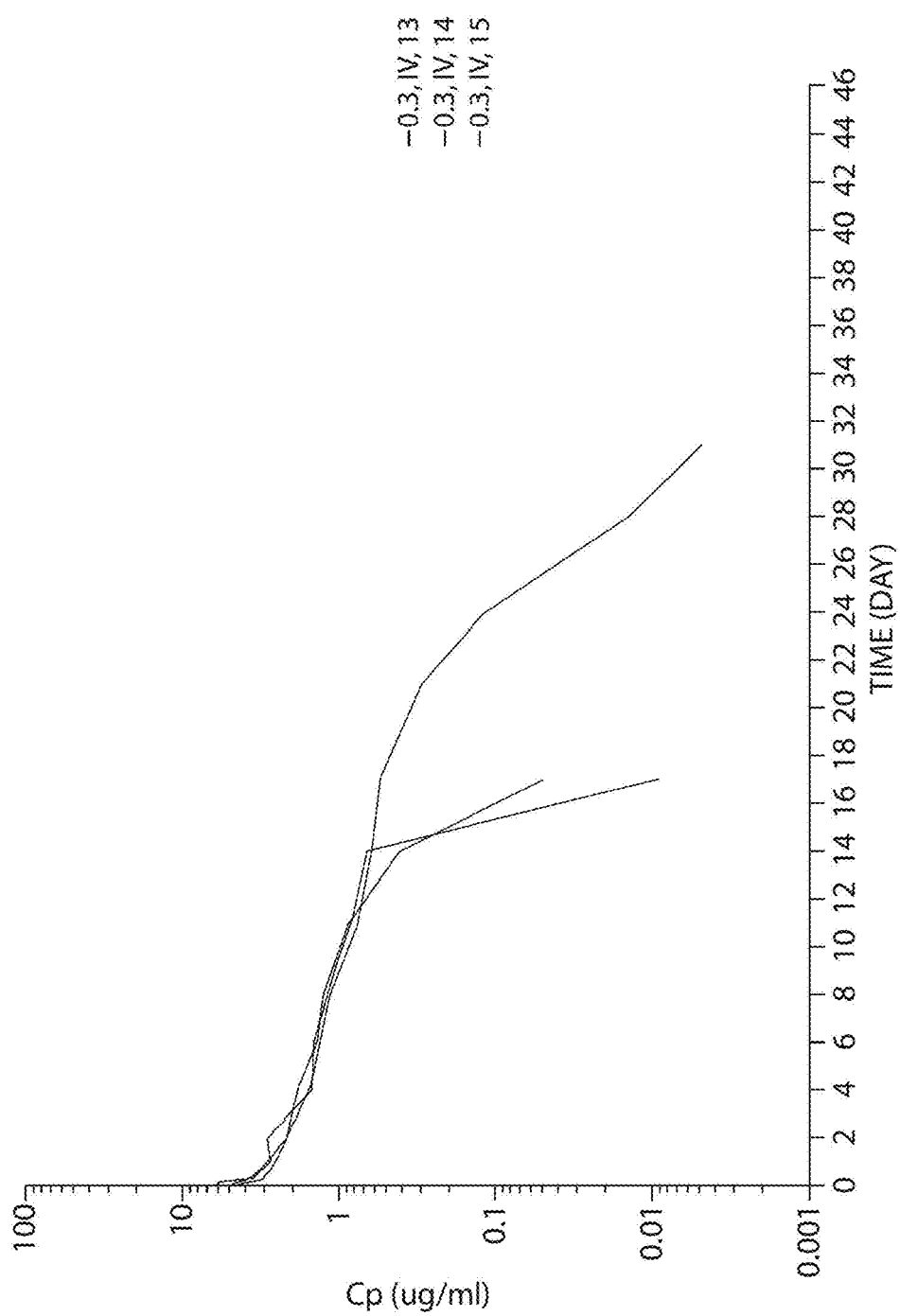
Figure 24-A

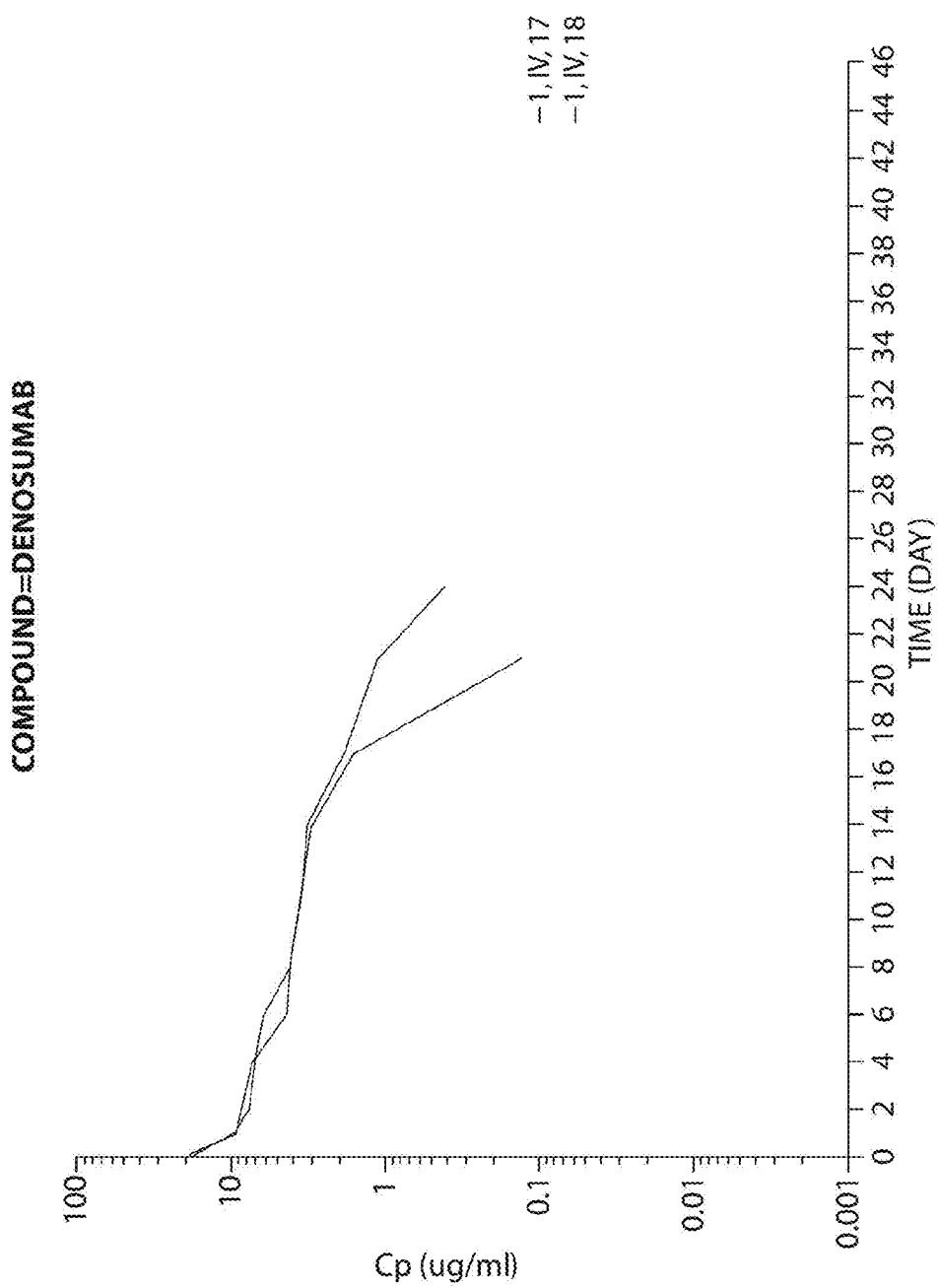
Figure 24-B

AMINO ACID SEQUENCES DIRECTED AGAINST RANK-L AND POLYPEPTIDES COMPRISING THE SAME FOR THE TREATMENT OF BONE DISEASES AND DISORDERS

RELATED APPLICATIONS

This application is a continuation-in-part of international application PCT/EP2008/056383, filed May 23, 2008, which was published under PCT Article 21(2) in English, which claims the benefit under 35 U.S.C. §119(e) of U.S. provisional application No. 60/939,929, filed May 24, 2007, and of U.S. provisional application No. 61/024,256, filed Jan. 29, 2008, each of which is incorporated by reference herein.

FIELD OF THE INVENTION

The present invention relates to amino acid sequences that are directed against (as defined herein) Receptor Activator of Nuclear factor Kappa B Ligand (RANK-L, also called tumor necrosis factor-related, activation-induced cytokine (TRANCE), osteoclast differentiation factor (ODF), osteoprotegerin ligand (OPG-L) or tumor necrosis factor superfamily member 11 (TNFSF11)), as well as to compounds or constructs, and in particular proteins and polypeptides, that comprise or essentially consist of one or more such amino acid sequences (also referred to herein as "amino acid sequences of the invention", "compounds of the invention", and "polypeptides of the invention", respectively).

The invention also relates to nucleic acids encoding such amino acid sequences and polypeptides (also referred to herein as "nucleic acids of the invention" or "nucleotide sequences of the invention"); to methods for preparing such amino acid sequences and polypeptides; to host cells expressing or capable of expressing such amino acid sequences or polypeptides; to compositions, and in particular to pharmaceutical compositions, that comprise such amino acid sequences, polypeptides, nucleic acids and/or host cells; and to uses of such amino acid sequences or polypeptides, nucleic acids, host cells and/or compositions, in particular for prophylactic, therapeutic or diagnostic purposes, such as the prophylactic, therapeutic or diagnostic purposes mentioned herein.

Other aspects, embodiments, advantages and applications of the invention will become clear from the further description herein.

BACKGROUND OF THE INVENTION

Remodelling (turnover) of bone is the process by which the adult skeleton is continually being resorbed (removed) and formed (replaced). Bone remodeling involves the synthesis of bone matrix by osteoblasts and its resorption by osteoclast cells. Osteoclasts, derived from hematopoietic cells, are unique forms of tissue macrophages that have the capacity to resorb bone tissue. Osteoblasts are specialized fibroblasts that have the capacity of secreting bone collagen. There is an exquisite coordination among the activities of these bone cells that link the processes of bone formation and bone resorption.

Bone remodelling is controlled by a balance between RANK-L/RANK and the RANK-L decoy receptor OPG. RANK-L and its receptor RANK are essential for the development and activation of osteoclasts. OPG, a secreted protein, is an effective inhibitor of osteoclast maturation and osteoclasts activation. In normal bone homeostasis, RANK-L and OPG participate in a cytokine axis that tightly controls the generation of osteoclasts from monocyte precursors. RANK-L, expressed by osteoblasts and bone marrow stromal cells, binds to its functional receptor, RANK, to stimulate differentiation of osteoclasts from precursor cells and the proliferation and activity of mature osteoclasts. OPG, which is expressed by osteoblasts, stromal cells, dendritic cells, and megakaryocytes, limits this process by acting as a soluble decoy receptor for RANK-L.

The TNF family molecule RANK-L is encoded by a single gene (rankl) at human chromosome 13q14. RANK-L mRNA is expressed at highest levels in bone and bone marrow, as well as in lymphoid tissues (lymph node, thymus, spleen, fetal liver, and Peyer's patches) (Anderson et al. 1997, Nature 390: 175-179; Wong et al. 1997, J. Biol. Chem. 272: 25190-25194; Lacey et al. 1998, Cell 93: 165-176; Yasuda et al. 1998, Proc. Natl. Acad. Sci. USA 95: 3597-3602). Alternative splicing of RANK-L mRNA allows expression as a type II transmembrane glycoprotein of either 316 or 270 amino acids or as a soluble ligand of 243 amino acids (Kong et al. 1999, Nature 397: 315-323; Nagai et al. 2000, Biochem Biophys. Res. Commun. 269: 532-536). In addition, RANK-L can be released from its membrane bound state by metalloproteinases, including TNF-alpha convertase (Lum et al. 1999, J. Biol. Chem. 274: 13613-13618). All four isoforms of RANK-L associate into trimeric molecules capable of triggering osteoclastogenesis.

RANK (receptor activator of NFkappaB also known as TRANCE-R, ODAR, or TNFRSF11A), expressed on preosteoclastic cells, is the sole receptor on these cells for RANK-L (Li et al. 2000, Proc. Natl. Acad. Sci. USA 97: 1566-1571). RANK activation by RANK-L is followed by its interaction with TNF receptor-associated (TRAF) family members, activation of nuclear factor (NF)-kappaB and c-Fos, JNK, c-src, and the serine/threonine kinase Akt/PKB (Anderson et al. 1997, Nature 390: 175-179; Hsu et al. 1999, Proc. Acad. Sci. USA 96: 3540-3545).

OPG (osteoprotegerin; "protector of the bone"; also known as osteoclastogenesis inhibitory factor (OCIF)) is a soluble, 110-kDa, disulfide-linked, homodimeric glycoprotein produced and released by activated osteoblast cells (Simonet et al. 1997, Cell 89: 309-319) with homology to the TNF receptor family, that functions as a decoy receptor for RANK-L and competes with RANK for RANK-L binding. Consequently, OPG is an effective inhibitor of osteoclast maturation and osteoclast activation (Simonet et al. 1997, Cell 89: 309-319; Lacey et al. 1998, Cell 93: 165-176; Kong et al. 1999, Nature 397: 315-323), thereby reducing bone resorption.

A more detailed overview of the OPG/RANK-L/RANK system as the mediator of bone formation and destruction is presented in Khosla, (2001 Endocrinology 142: 5050-5055), Holstead Jones et al. (2002, Ann. Rheum. Dis. 61 (Suppl II): ii32-ii39), Bezerra et al. (2005, Brazilian J. Med. Biol. Res. 38: 161-170) and McClung (2006, Current Osteoporosis Reports 4: 28-33).

Several bone disorders occur when there is an imbalance between the resorption and formation components of bone remodeling activity (uncoupling of bone homeostasis). Imbalances between osteoclast and osteoblast activities can arise from a wide variety of hormonal changes or perturbations of inflammatory and growth factors, such as e.g. an altered balance between OPG and RANK-L. When bone resorption is greater than bone formation, there is a net loss of bone over time. This can eventually result in low bone mass (osteopenia) or osteoporosis. When bone formation exceeds resorption, there is a net increase in bone mass (osteopetrosis).

Excessive bone loss or destruction due to higher RANK-L, lower OPG or both has been implicated in many disease states, including post-menopausal osteoporosis (Eghbali-Fatourechi et al. 2003, Journal of Clinical Investigation 111: 1221-1230; Tsangari et al. 2004, Bone 35: 334-342; Abdallah et al. 2005, Calcified Tissue International 76: 90-97), primary hyperparathyroidism (Stilgren et al. 2004, Bone 35: 256-265; Johnell et al. 2005, Journal of Bone and Mineral Research 20: 1185-1194), Paget's disease of bone (Reddy 2004, Journal of Cellular Biochemistry 93: 688-696), metastatic bone disease (Brown 2004, Cancer Treatment and Research 118: 149-172), myeloma (Okada et al. 2003, Clinical and Experimental Metastasis 20: 639-646), rheumatoid arthritis (Crotti et al. 2002, Annals of the Rheumatic Diseases 61: 1047-1054) and several other metabolic or inflammatory bone and joint disorders (Locklin et al. 2001, Bone 28 (Suppl.): S80; Lewiecki 2006, Expert Opin. Biol. Ther. 6: 1041-1050).

Pharmacological agents to decrease risk of fracture have been available for more than ten years. Anticatabolic drugs (oestrogens, bisphosphonates, calcitonin and selective oestrogen receptor modulators) decrease bone resorption, while anabolic agents, such as recombinant human parathyroid hormone (PTH), increase bone formation and bone size. The bisphosphonate class of drugs is the one most often used for the treatment of osteoporosis. Although this drug class is generally very safe, oral dosing is complex and has been associated with gastrointestinal adverse events in a small percentage of clinical practice patients. Clinical trials are evaluating increasing intervals of intravenous bisphosphonate dosing.

The recent discovery of the OPG/RANK-L/RANK system as pivotal regulatory factors in the pathogenesis of bone diseases and disorders like osteoporosis provides unique targets for therapeutic agents. In laboratory animals and in humans, administering forms of OPG markedly inhibited osteoclast activity and improved bone strength (Bekker et al. 2001, J. Bone Miner. Res. 16: 348-360; Campagnuolo et al. 2002, Arthritis Rheum. 46: 1926-1936; Bezerra et al. 2005, Brazilian J. Med. Biol. Res. 38: 161-170; McClung 2006, Current Osteoporosis Reports 4: 28-33). In early studies in humans, a fully human antibody against RANK-L (Denosumab) reduced bone turnover and improved bone density (Body et al. 2003, Cancer 97: 887-892; Bekker et al. 2004, J. Bone Miner. Res. 19: 1059-1066; McClung 2006, Current Osteoporosis Reports 4: 28-33; Lewiecki 2006, Expert Opin. Biol. Ther. 6: 1041-1050; McClung et al. 2006, N. Engl. J. Med. 354: 821-831). Such complete antibodies, however, face the drawbacks of full size antibodies such as high production costs, low stability, and their large size, which e.g. impedes their access to certain hidden epitopes.

SUMMARY OF THE INVENTION

NANOBODIES (a novel class of proprietary therapeutic proteins derived from heavy-chain variable domains (VHH) that occur naturally in heavy chain only immunoglobulins; singular, NANOBODY) are more potent and more stable than conventional four-chain antibodies which leads to (1) lower dosage forms, less frequent dosage leading to less side effects; and (2) improved stability leading to a broader choice of administration routes, comprising oral or subcutaneous routes and slow-release formulations in addition to the intravenous route.

Because of their small size, NANOBODIES have the ability to cross membranes and penetrate into physiological compartments, tissues and organs not accessible to other, larger polypeptides and proteins. NANOBODIES might, for example, easily penetrate into the bone matrix making them suited for the treatment of bone diseases and disorders.

The small size of the NANOBODY also makes them ideally suited for their engineering into multivalent or multispecific polypeptides. In contrast to full antibodies which can bind to only one subunit of the RANK-L trimer, bivalent or trivalent polypeptides (based on respectively two or three NANOBODIES against RANK-L), will be able to bind on respectively 2 or 3 subunits of the trimeric RANK-L molecule and might be advantageous because of their higher potency.

The amino acid sequences, polypeptides and compositions of the present invention can generally be used to modulate, and in particular inhibit and/or prevent, binding of RANK-L to RANK, and thus to modulate, and in particular inhibit or prevent, the signalling that is mediated by RANK-L, RANK and/or OPG, to modulate the biological pathways in which RANK-L and/or RANK are involved, and/or to modulate the biological mechanisms, responses and effects associated with such signalling or these pathways. The binding of RANK-L to RANK and/or the signalling that is mediated by RANK-L, RANK and/or OPG may be inhibited and/or prevented by at least 1%, preferably at least 5%, such as at least 10% or at least 25%, for example by at least 50%, at least 60%, at least 70%, at least 80%, or 90% or more, compared to the binding of RANK-L to RANK and/or the signalling that is mediated by RANK-L, RANK and/or OPG under the same conditions but without the presence of the amino acid sequence, NANOBODY or polypeptide of the invention.

In another aspect of the present invention, the amino acid sequences, polypeptides and compositions of the present invention can be used to modulate, and in particular inhibit and/or prevent, binding of RANK-L to OPG, and thus to modulate (inhibit and/or prevent or boost) the signalling that is mediated by RANK-L, RANK and/or OPG, to modulate the biological pathways in which RANK-L, RANK and/or OPG are involved, and/or to modulate the biological mechanisms, responses and effects associated with such signalling or these pathways. The amino acid sequences, polypeptides and compositions of the present invention may be agonist or antagonist of RANK-L and/or such signalling. They may inhibit RANK/RANK-L mediated signalling in the same way as OPG, or they may fully or partially prevent OPG from inhibiting RANK/RANK-L mediated signalling. The binding of RANK-L to OPG and/or the signalling that is mediated by RANK-L, RANK and/or OPG may be inhibited and/or prevented by at least 1%, preferably at least 5%, such as at least 10% or at least 25%, for example by at least 50%, at least 60%, at least 70%, at least 80%, or 90% or more, compared to the binding of RANK-L to OPG and/or the signalling that is mediated by RANK-L, RANK and/or OPG under the same conditions but without the presence of the amino acid sequence, NANOBODY or polypeptide of the invention.

In another aspect of the present invention, the amino acid sequences, polypeptides and compositions of the invention can be used to modulate (inhibit and/or prevent or boost) the differentiation and/or proliferation of osteoclasts. The differentiation and/or proliferation of osteoclasts may be increased or decreased, respectively, by at least 1%, preferably at least 5%, such as at least 10% or at least 25%, for example by at least 50%, at least 60%, at least 70%, at least 80%, or 90% or more, compared to the differentiation and/or proliferation of osteoclasts under the same conditions but without the presence of the amino acid sequence, NANOBODY or polypeptide of the invention.

In another aspect of the present invention, the amino acid sequences, polypeptides and compositions of the invention can be used to modulate bone remodelling. Bone remodelling may be modulated at least 1%, preferably at least 5%, such as at least 10% or at least 25%, for example by at least 50%, at least 60%, at least 70%, at least 80%, or 90% or more, compared to bone remodelling under the same conditions but without the presence of the amino acid sequence, NANOBODY or polypeptide of the invention.

As such, the polypeptides and compositions of the present invention can be used for the prevention and treatment (as defined herein) of bone diseases and disorders. Generally, "bone diseases and disorders" can be defined as diseases and disorders that can be prevented and/or treated, respectively, by suitably administering to a subject in need thereof (i.e. having the disease or disorder or at least one symptom thereof and/or at risk of attracting or developing the disease or disorder) of either a polypeptide or composition of the invention (and in particular, of a pharmaceutically active amount thereof) and/or of a known active principle active against RANK-L or a biological pathway or mechanism in which RANK-L is involved (and in particular, of a pharmaceutically active amount thereof).

Bone diseases and disorders encompass diseases and disorders associated with the regulation of bone formation and resorption. Bone diseases and disorders characterized by a net bone loss (bone resorption exceeds bone formation) are also referred to as osteopenic disorders, including ostopenia, osteoporosis and osteolysis and are characterized by excessive and/or unwanted signaling mediated by RANK-L. The polypeptides and compositions of the present invention that modulate, and in particular inhibit and/or prevent, binding of RANK-L to RANK act as antagonist and will generally be used for the prevention and treatment (as defined herein) of bone diseases and disorders characterized by net bone loss. Also polypeptides and compositions of the present invention that modulate, and in particular inhibit and/or prevent, binding of RANK-L to OPG may act as antagonists and will generally be used for the prevention and treatment (as defined herein) of bone diseases and disorders characterized by net bone loss.

Bone diseases and disorders characterized by net increase in bone mass are referred to as osteopetrosis and are characterized by poor signaling mediated by RANK-L. The polypeptides and compositions of the present invention that modulate, and in particular inhibit and/or prevent, binding of RANK-L to OPG may act as agonists and will generally be used for the prevention and treatment (as defined herein) of bone diseases and disorders characterized by net increase in bone mass.

Examples of such bone diseases and disorders will be clear to the skilled person based on the disclosure herein, and for example include the following diseases and disorders: Osteoporosis (McClung 2006, Current Osteoporosis Reports 4: 28-33), including, but not limited to, primary osteoporosis, endocrine osteoporosis (including, but not limited to, hyperthyroidism, hyperparathyroidism (Anandarajah and Schwarz 2006, J. Cell Biochem. 97: 226-232), Cushing's syndrome, and acromegaly), hereditary and congenital forms of osteoporosis (including, but not limited to, osteogenesis imperfecta, homocystinuria, Menkes' syndrome, Riley-Day syndrome), osteoporosis due to immobilization of extremities, glucocorticoid-induced osteoporosis (Locklin et al. 2001, Bone 28 (Suppl.): S80; McClung 2006, Current Osteoporosis Reports 4: 28-33; Anandarajah and Schwarz 2006, J. Cell Biochem. 97: 226-232) and postmenopausal osteoporosis (McClung 2006, Current Osteoporosis Reports 4: 28-33); (Juvenile or Familial) Paget's disease (Cundy et al. 2002, Hum. Mol. Genet. 11: 2119-2127; Whyte et al. 2002, J. Bone Miner. Res. 17: 26-29; Whyte et al. 2002, N. Engl. J. Med. 347: 175-184; Johnson-Pais et al. 2003, J. Bone Miner Res. 18: 376-380; Anandarajah and Schwarz 2006, J. Cell Biochem. 97: 226-232; Anandarajah and Schwarz 2006, J. Cell Biochem. 97: 226-232); Osteomyelitis, i.e., an infectious lesion in bone, leading to bone loss; Hypercalcemia (Anandarajah and Schwarz 2006, J. Cell Biochem. 97: 226-232), including, but not limited to, hypercalcemia resulting from solid tumors (including, but not limited to, breast, lung and kidney) and hematologic malignancies (including, but not limited to, multiple myeloma (Sordillo and Pearse 2003, Cancer 97 (3 Suppl): 802-812; Vanderkerken et al. 2003, Cancer Res. 63: 287-289), lymphoma and leukemia), idiopathic hypercalcemia, and hypercalcemia associated with hyperthyroidism and renal function disorders; Bone loss, including but not limited to, osteopenia following surgery, osteopenia induced by steroid administration, osteopenia associated with disorders of the small and large intestine, and osteopenia associated with chronic hepatic and renal diseases; Osteonecrosis, i.e., bone cell death, including, but not limited to, osteonecrosis associated with traumatic injury, osteonecrosis associated with Gaucher's disease, osteonecrosis associated with sickle cell anemia, osteonecrosis associated with systemic lupus erythematosus, osteonecrosis associated with rheumatoid arthritis, osteonecrosis associated with periodontal disease, osteonecrosis associated with osteolytic metastasis, and osteonecrosis associated with other condition; Bone loss associated with arthritic disorders such as psoriatic arthritis, rheumatoid arthritis, loss of cartilage and joint erosion associated with rheumatoid arthritis (Bezerra et al. 2005, Brazilian Journal of Medical and Biological Research 38: 161-170; Anandarajah and Schwarz 2006, J. Cell Biochem. 97: 226-232); Arthritis (Bezerra et al. 2005, Brazilian Journal of Medical and Biological Research 38: 161-170), including inflammatory arthritis (McClung 2006, Current Osteoporosis Reports 4: 28-33), Collagen-induced arthritis (Bezerra et al. 2005, Brazilian Journal of Medical and Biological Research 38: 161-170); Periprosthetic osteolysis (McClung 2006, Current Osteoporosis Reports 4: 28-33; Anandarajah and Schwarz 2006, J. Cell Biochem. 97: 226-232); Cancer-related bone disease (McClung 2006, Current Osteoporosis Reports 4: 28-33); Bone loss associated with aromatase inhibitor therapy (Lewiecki 2006, Expert Opin. Biol. Ther. 6: 1041-1050); Bone loss associated with androgen deprivation therapy (Lewiecki 2006, Expert Opin. Biol. Ther. 6: 1041-1050); Bone loss associated bone metastasis; Bone loss associated with diseases having immune system involvement, such as adult and childhood leukaemias, cancer metastasis, autoimmunity, and various viral infections (Holstead Jones et al. 2002, Ann. Rheum. Dis. 61 (Suppl II): ii32-ii39) Osteopenic disorders such as adult and childhood leukaemia (Oliveri et al. 1999, Henry Ford Hosp. Med. 39: 45-48), chronic infections such as hepatitis C or HIV (Stellon et al. 1985, Gastroenterology 89: 1078-1083), autoimmune disorders such as diabetes mellitus (Piepkom et al. 1997, Horm. Metab. Res. 29: 584-91), and lupus erythematosus (Seitz et al. 1985, Ann. Rheum Dis. 44: 438-445), allergic diseases such as asthma (Ebeling et al. 1998, J. Bone Min. Res. 13: 1283-1289), lytic bone metastases in multiple cancers such as breast cancer (Coleman 1998, Curr. Opin. Oncol. 10 (Suppl 1): 7-13); Prostate cancer; Myeloma bone disease (Anandarajah and Schwarz 2006, J. Cell Biochem. 97: 226-232); Periodontal infections (Anandarajah and Schwarz 2006, J. Cell Biochem. 97: 226-232); Expansile skeletal hyperphosphatasia (Anandarajah and Schwarz 2006, J. Cell Biochem. 97: 226-232); Bone metastases (Lewiecki 2006, Expert Opin. Biol. Ther. 6: 1041-1050; Anandarajah and Schwarz 2006, J. Cell Biochem. 97: 226-232).

Also encompassed within the scope of the present invention is the prevention and/or treatment with the amino acid sequences, the compounds and/or the polypeptides of the invention of other diseases and disorders associated with an imbalance in the RANK-L/RANK/OPG pathway. Such diseases and disorders include but are not limited to osteoporosis, inflammatory conditions, autoimmune conditions, asthma, rheumatoid arthritis, multiple sclerosis, Multiple myeloma (Sordillo and Pearse 2003, Cancer 97 (3 Suppl): 802-812; Vanderkerken et al. 2003, Cancer Res. 63: 287-289); Vascular diseases (Anandarajah and Schwarz 2006, J. Cell Biochem. 97: 226-232) and Cardiovascular disease (Lewiecki 2006, Expert Opin. Biol. Ther. 6: 1041-1050).

Also encompassed within the scope of the present invention is the prevention and/or treatment with the amino acid sequences, the compounds and/or the polypeptides of the invention of diseases and disorders associated with osteopetrosis such as osteopetrosis tarda, osteopetrosis congenita and marble bone disease.

In particular, the polypeptides and compositions of the present invention can be used for the prevention and treatment of bone diseases and disorders which are mediated by the pathway(s) in which RANK-L is involved. Examples of such bone diseases and disorders will again be clear to the skilled person based on the disclosure herein.

Thus, without being limited thereto, the amino acid sequences and polypeptides of the invention can for example be used to prevent and/or to treat all diseases and disorders that are currently being prevented or treated with active principles that can modulate RANK-L-mediated signalling, such as those mentioned in the prior art cited above. It is also envisaged that the polypeptides of the invention can be used to prevent and/or to treat all diseases and disorders for which treatment with such active principles is currently being developed, has been proposed, or will be proposed or developed in future. In addition, it is envisaged that, because of their favourable properties as further described herein, the polypeptides of the present invention may be used for the prevention and treatment of other diseases and disorders than those for which these known active principles are being used or will be proposed or developed; and/or that the polypeptides of the present invention may provide new methods and regimens for treating the diseases and disorders described herein.

Thus, without being limited thereto, the amino acid sequences and polypeptides of the invention can for example be used to prevent and/or to treat all diseases and disorders that are currently being prevented or treated with Denosumab.

Other applications and uses of the amino acid sequences and polypeptides of the invention will become clear to the skilled person from the further disclosure herein.

Generally, it is an object of the invention to provide pharmacologically active agents, as well as compositions comprising the same, that can be used in the diagnosis, prevention and/or treatment of bone diseases and disorders and of the further diseases and disorders mentioned herein; and to provide methods for the diagnosis, prevention and/or treatment of such diseases and disorders that involve the administration and/or use of such agents and compositions.

In particular, it is an object of the invention to provide such pharmacologically active agents, compositions and/or methods that have certain advantages compared to the agents, compositions and/or methods that are currently used and/or known in the art. These advantages will become clear from the further description below.

More in particular, it is an object of the invention to provide therapeutic proteins that can be used as pharmacologically active agents, as well as compositions comprising the same, for the diagnosis, prevention and/or treatment of bone diseases and disorders and of the further diseases and disorders mentioned herein; and to provide methods for the diagnosis, prevention and/or treatment of such diseases and disorders that involve the administration and/or the use of such therapeutic proteins and compositions.

Accordingly, it is a specific object of the present invention to provide amino acid sequences that are directed against (as defined herein) RANK-L, in particular against RANK-L from a warm-blooded animal, more in particular against RANK-L from a mammal, and especially against human RANK-L; and to provide proteins and polypeptides comprising or essentially consisting of at least one such amino acid sequence.

In particular, it is a specific object of the present invention to provide such amino acid sequences and such proteins and/or polypeptides that are suitable for prophylactic, therapeutic and/or diagnostic use in a warm-blooded animal, and in particular in a mammal, and more in particular in a human being.

More in particular, it is a specific object of the present invention to provide such amino acid sequences and such proteins and/or polypeptides that can be used for the prevention, treatment, alleviation and/or diagnosis of one or more diseases, disorders or conditions associated with RANK-L and/or mediated by RANK-L (such as the diseases, disorders and conditions mentioned herein) in a warm-blooded animal, in particular in a mammal, and more in particular in a human being.

It is also a specific object of the invention to provide such amino acid sequences and such proteins and/or polypeptides that can be used in the preparation of pharmaceutical or veterinary compositions for the prevention and/or treatment of one or more diseases, disorders or conditions associated with and/or mediated by RANK-L (such as the diseases, disorders and conditions mentioned herein) in a warm-blooded animal, in particular in a mammal, and more in particular in a human being.

In the invention, generally, these objects are achieved by the use of the amino acid sequences, proteins, polypeptides and compositions that are described herein.

In general, the invention provides amino acid sequences that are directed against (as defined herein) and/or can specifically bind (as defined herein) to RANK-L; as well as compounds and constructs, and in particular proteins and polypeptides, that comprise at least one such amino acid sequence.

More in particular, the invention provides amino acid sequences can bind to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein; as well as compounds and constructs, and in particular proteins and polypeptides, that comprise at least one such amino acid sequence.

In particular, amino acid sequences and polypeptides of the invention are preferably such that they:

bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to RANK-L with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to RANK-L with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a monovalent amino acid sequence of the invention (or a polypeptide that contains only one amino acid sequence of the invention) is preferably such that it will bind to RANK-L with an affinity less than 500 nM, preferably less than 200 nM, more preferably less than 10 nM, such as less than 500 pM.

Some preferred EC50 and IC50 values for binding of the amino acid sequences or polypeptides of the invention to RANK-L will become clear from the further description and examples herein.

For binding to RANK-L, an amino acid sequence of the invention will usually contain within its amino acid sequence one or more amino acid residues or one or more stretches of amino acid residues (i.e. with each "stretch" comprising two or amino acid residues that are adjacent to each other or in close proximity to each other, i.e. in the primary or tertiary structure of the amino acid sequence) via which the amino acid sequence of the invention can bind to RANK-L, which amino acid residues or stretches of amino acid residues thus form the "site" for binding to RANK-L (also referred to herein as the "antigen binding site").

The amino acid sequences provided by the invention are preferably in essentially isolated form (as defined herein), or form part of a protein or polypeptide of the invention (as defined herein), which may comprise or essentially consist of one or more amino acid sequences of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than RANK-L), so as to provide a monovalent, multivalent or multispecific polypeptide of the invention, respectively, all as described herein. Such a protein or polypeptide may also be in essentially isolated form (as defined herein).

The amino acid sequences and polypeptides of the invention as such preferably essentially consist of a single amino acid chain that is not linked via disulphide bridges to any other amino acid sequence or chain (but that may or may not contain one or more intramolecular disulphide bridges. For example, it is known that NANOBODIES—as described herein—may sometimes contain a disulphide bridge between CDR3 and CDR1 or FR2). However, it should be noted that one or more amino acid sequences of the invention may be linked to each other and/or to other amino acid sequences (e.g. via disulphide bridges) to provide peptide constructs that may also be useful in the invention (for example Fab' fragments, F(ab')$_2$ fragments, ScFv constructs, "diabodies" and other multispecific constructs. Reference is for example made to the review by Holliger and Hudson, Nat Biotechnol. 2005 September; 23(9):1126-36).

Generally, when an amino acid sequence of the invention (or a compound, construct or polypeptide comprising the same) is intended for administration to a subject (for example for therapeutic and/or diagnostic purposes as described herein), it is preferably either an amino acid sequence that does not occur naturally in said subject; or, when it does occur naturally in said subject, in essentially isolated form (as defined herein).

It will also be clear to the skilled person that for pharmaceutical use, the amino acid sequences of the invention (as well as compounds, constructs and polypeptides comprising the same) are preferably directed against human RANK-L; whereas for veterinary purposes, the amino acid sequences and polypeptides of the invention are preferably directed against RANK-L from the species to be treated, or at least cross-reactive with RANK-L from the species to be treated.

Furthermore, an amino acid sequence of the invention may optionally, and in addition to the at least one binding site for binding against RANK-L, contain one or more further binding sites for binding against other antigens, proteins or targets.

The efficacy of the amino acid sequences and polypeptides of the invention, and of compositions comprising the same, can be tested using any suitable in vitro assay, cell-based assay, in vivo assay and/or animal model known per se, or any combination thereof, depending on the specific disease or disorder involved. Suitable in vitro assays will be clear to the skilled person, and for example include ELISA; FACS binding assay; BIACORE (surface plasmon resonance); competition binding assay (AlphaScreen®, Perkin Elmer, Massachusetts, USA; FMAT); TRAP assay (osteoclast differentiation assay; Rissanen et al. 2005, J. Bone Miner. Res. 20, Suppl. 1: S256); NF-kappaB reporter gene assay (Mizukami et al. 2002, Mol. Cell. Biol. 22: 992-1000). EC50 values for binding of the NANOBODIES of the invention (and of polypeptides comprising the same) to RANK-L in, for example ELISA or FACS are preferably 1 μM to 1 pM, more preferably 1 nM to 1 pM and more preferably 100 pM to 1 pM. IC50 values for binding of the NANOBODIES of the invention (and of polypeptides comprising the same) to RANK-L in, for example, AlphaScreen®, NF-kappaB assay or TRAP assay are preferably 1 μM to 1 pM, more preferably 1 nM to 1 pM and more preferably 100 pM to 1 pM.

Suitable animal models will be clear to the skilled person, and for example include (SCID)/ARH-77 mouse model (Sordillo and Pearse 2003, Cancer 97 (3 Suppl): 802-812); SCID-hu mouse model of human MM (Sordillo and Pearse 2003, Cancer 97 (3 Suppl): 802-812; Tassone et al. 2005, Blood 106: 713-716); Transgenic mice that overexpress OPG under control of apoE gene promoter and associated enhancer (Simonet et al. 1997, Cell 89: 309-319); Mouse model of sarcoma-induced bone destruction (Honore et al. 2000, Nat. Med. 6: 521-528); Ovariectomized animal models such as, for example, ovariectomized monkeys (Jerome et al. 1995, Bone 17: 403S-408S), ovariectomized mice (Roggia et al. 2001, Proc. Natl. Acad. Sci. USA 20: 13960-13965) or ovariectomized rats and cynomolgus monkeys (Simonet et al. 1997, Cell 89: 309-319; Høegh-Andersen et al. 2004, Arthritis Res. Ther. 6: R169-R180); Rat (animal) models for arthritis (Bendele et al. 1999, Toxicologic Pathology 27: 134-142; Romas et al. 2002, Am. J. Pathol. 161: 1419-1427; Mori et al. 2002, Histochemistry and Cell Biology 117: 283-292) such as models for collagen-induced arthritis or models for adjuvant-induced arthritis; Animal models of tumor-derived PTHrP-induced hypercalcemia (Morony et al. 1999, J. Bone Miner. Res. 14: 1478-1485; Capparelli et al. 2000, Cancer Res. 60: 783-778); Murine model of multiple myeloma (Vanderkerken et al. 2003, Cancer Res. 63: 287-289); Inflammatory Bowel Disease model in mice (Byrne et al. 2005, Gut 54: 78-86); Transgenic mice overexpressing MIF (Onodera et al. 2006, J. Bone Miner. Res. 21: 876-885); Transgenic mice overexpressing soluble osteoclast differentiation factor (sODF) (Mizuno et al. 2002, 20: 337-44); Transgenic mice expressing CSF-1 under control of the CSF-1R promoter/first intron driver [transgene TgN(Csf1r-Csf1)Ers (TgRC) mice] (Wei et al. 2006, J. Leukoc. Biol. 80: 1445-1453); Transgenic mice overexpressing core-binding factor alpha1 (Cbfa1) (Geoffroy et al. Mol. Cell Biol. 22: 6222-6233); Transgenic mice overexpressing Decoy receptor 3 (DcR3) (Tang et al. 2007, J. Biol. Chem. 282: 2346-2354), as well as the assays and animal models used in the experimental part below and in the prior art cited herein.

Also, according to the invention, amino acid sequences and polypeptides that are directed against RANK-L from a first species of warm-blooded animal may or may not show cross-reactivity with RANK-L from one or more other species of warm-blooded animal. For example, amino acid sequences and polypeptides directed against human RANK-L may or may not show cross reactivity with RANK-L from one or more other species of primates (such as, without limitation, monkeys from the genus Macaca (such as, and in particular, cynomolgus monkeys (Macaca fascicularis) and/or rhesus monkeys (Macaca mulatta)) and baboon (Papio ursinus)) and/or with RANK-L from one or more species of animals that are often used in animal models for diseases (for example mouse, rat, rabbit, pig or dog), and in particular in animal models for diseases and disorders associated with RANK-L (such as the species and animal models mentioned herein). In this respect, it will be clear to the skilled person that such cross-reactivity, when present, may have advantages from a drug development point of view, since it allows the amino acid sequences and polypeptides against human RANK-L to be tested in such disease models.

More generally, amino acid sequences and polypeptides of the invention that are cross-reactive with RANK-L from multiple species of mammal will usually be advantageous for use in veterinary applications, since it will allow the same amino acid sequence or polypeptide to be used across multiple species. Thus, it is also encompassed within the scope of the invention that amino acid sequences and polypeptides directed against RANK-L from one species of animal (such as amino acid sequences and polypeptides against human RANK-L) can be used in the treatment of another species of animal, as long as the use of the amino acid sequences and/or polypeptides provide the desired effects in the species to be treated.

In one embodiment, the amino acid sequences and polypeptides of the invention directed against human RANK-L are cross-reactive with RANK-L from cynomolgus monkey.

In another embodiment, the amino acid sequences and polypeptides of the invention directed against human RANK-L are cross-reactive with RANK-L from mice or rats.

In another embodiment, the amino acid sequences and polypeptides of the invention directed against human RANK-L are cross-reactive with RANK-L from cynomolgus monkey and with RANK-L from mice or rats.

In another embodiment, the amino acid sequences and polypeptides of the invention directed against human RANK-L are not cross-reactive with RANK-L from mice or rats.

In another embodiment, the amino acid sequences and polypeptides of the invention directed against human RANK-L are cross-reactive with RANK-L from cynomolgus monkey while not being cross-reactive with RANK-L from mice or rats.

In another embodiment, the amino acid sequences and polypeptides of the invention directed against human RANK-L are not cross-reactive with RANK-L from cynomolgus monkey.

In another embodiment, the amino acid sequences and polypeptides of the invention directed against human RANK-L are not cross-reactive with RANK-L from cynomolgus monkey and not with RANK-L from mice or rats.

The present invention is in its broadest sense also not particularly limited to or defined by a specific antigenic determinant, epitope, part, domain, subunit or confirmation (where applicable) of RANK-L against which the amino acid sequences and polypeptides of the invention are directed. For example, the amino acid sequences and polypeptides may or may not be directed against an "interaction site" (as defined herein). However, it is generally assumed and preferred that the amino acid sequences and polypeptides of the invention are preferably directed against an interaction site (as defined herein), and in particular against the binding site on RANK-L for RANK or against the binding site on RANK-L for OPG.

Thus, in one preferred, but non-limiting aspect, the amino acid sequences and polypeptides of the invention are directed against the RANK receptor binding site on RANK-L, and are as further defined herein. Binding of the amino acid sequences and polypeptides of the invention to the RANK receptor binding site on RANK-L may inhibit and/or prevent binding of RANK-L to RANK, and thus inhibit or prevent the signalling that is mediated by this RANK-L/RANK binding. The amino acid sequences and polypeptides of the invention therefore can act as antagonists of the RANK-L/RANK mediated signalling.

In one, specific, but non-limiting aspect, the amino acid sequences and polypeptides of the invention are directed against the RANK receptor binding site on RANK-L while not interfering (reducing/inhibiting) with the RANK-L/OPG interaction. In this specific aspect, the amino acid sequences and polypeptides of the invention will act as antagonists of the RANK-L/RANK mediated signalling (and inhibit osteoclast maturation and activation) in addition to the OPG mediated inhibition of osteoclast maturation and activation.

In another preferred, but non-limiting aspect, the amino acid sequences and polypeptides of the invention are directed against the OPG binding site on RANK-L, and are as further defined herein. Binding of the amino acid sequences and polypeptides of the invention to the OPG binding site on RANK-L may inhibit and/or prevent binding of RANK-L to OPG. The amino acid sequences and polypeptides of the invention may therefore act as a competitive or as a non-competitive inhibitor of the binding of RANK-L to OPG (e.g. in ELISA, in AlphaScreen® assay, in TRAP assay and/or in NFkappaB assay). Binding of the amino acid sequences and polypeptides of the invention to the OPG binding site on RANK-L may, by its turn, inhibit and/or prevent binding of RANK-L to RANK, and thus inhibit and/or prevent the signalling that is mediated by this RANK-L/RANK binding. The amino acid sequences and polypeptides of the invention therefore can act as antagonists of the RANK-L and RANK-L/RANK mediated signalling (i.e. they inhibit RANK/RANK-L interaction).

In some cases, however, the amino acid sequences and polypeptides of the invention may be directed against an OPG binding site on RANK-L and interfere with the binding of RANK-L to OPG without essentially reducing the binding of RANK-L to RANK. In this case the amino acid sequences and polypeptides of the invention may boost the signalling that is mediated by this RANK-L/RANK interaction and act as agonists of the RANK-L and RANK-L/RANK mediated signalling (i.e. they act as antagonist of the action of OPG).

In another aspect of the present invention, the amino acid sequences and polypeptides of the invention are preferably directed against an epitope on RANK-L that overlaps with the epitope of Denosumab. Binding of the amino acid sequences and polypeptides of the invention to an epitope on RANK-L that overlaps with the epitope of Denosumab may inhibit and/or prevent binding of Denosumab to RANK-L. The amino acid sequences and polypeptides of the invention may therefore act as a competitive or as a non-competitive inhibitor of the binding of Denosumab to RANK-L (e.g. in ELISA, in AlphaScreen® assay, in TRAP assay and/or in NFkappaB assay).

As further described herein, a polypeptide of the invention may contain two or more amino acid sequences of the invention that are directed against RANK-L. Generally, such polypeptides will bind to RANK-L with increased avidity compared to a single amino acid sequence of the invention. Such a polypeptide may for example comprise two amino acid sequences of the invention that are directed against the same antigenic determinant, epitope, part, domain, subunit or confirmation (where applicable) of RANK-L (which may or may not be an interaction site); or comprise at least one "first" amino acid sequence of the invention that is directed against a first same antigenic determinant, epitope, part, domain, subunit or confirmation (where applicable) of RANK-L (which may or may not be an interaction site); and at least one "second" amino acid sequence of the invention that is directed against a second antigenic determinant, epitope, part, domain, subunit or confirmation (where applicable) different from the first (and which again may or may not be an interaction site). Preferably, in such "biparatopic" polypeptides of the invention, at least one amino acid sequence of the invention is directed against an interaction site (as defined herein), although the invention in its broadest sense is not limited thereto.

Thus, in one particular aspect, a polypeptide of the invention may comprise two or more amino acid sequences of the invention that are directed against the binding site for RANK on RANK-L; or comprise at least one "first" amino acid sequence of the invention that is directed against the binding site for RANK on RANK-L; and at least one "second" amino acid sequence of the invention that is directed against a second antigenic determinant, epitope, part, domain, subunit or confirmation different from the first and which is not a binding site for RANK on RANK-L.

Thus, in another particular aspect, a polypeptide of the invention may comprise two or more amino acid sequences of the invention that are directed against the binding site for OPG on RANK-L; or comprise at least one "first" amino acid sequence of the invention that is directed against the binding site for OPG on RANK-L; and at least one "second" amino acid sequence of the invention that is directed against a second antigenic determinant, epitope, part, domain, subunit or confirmation different from the first and which is not a binding site for OPG on RANK-L.

Also, when the target is part of a binding pair (for example, a receptor-ligand binding pair), the amino acid sequences and polypeptides may be such that they compete with the cognate binding partner (e.g. the ligand, receptor or other binding partner, as applicable) for binding to the target, and/or such that they (fully or partially) neutralize binding of the binding partner to the target.

It is also within the scope of the invention that, where applicable, an amino acid sequence of the invention can bind to two or more antigenic determinants, epitopes, parts, domains, subunits or confirmations of RANK-L. In such a case, the antigenic determinants, epitopes, parts, domains or subunits of RANK-L to which the amino acid sequences and/or polypeptides of the invention bind may be essentially the same (for example, if RANK-L contains repeated structural motifs or occurs in a multimeric form) or may be different (and in the latter case, the amino acid sequences and polypeptides of the invention may bind to such different antigenic determinants, epitopes, parts, domains, subunits of RANK-L with an affinity and/or specificity which may be the same or different). In a preferred, but non-limiting aspect, the amino acid sequences and polypeptides of the invention bind two or three subunits of the RANK-L trimer. Also, for example, the amino acid sequences and polypeptides of the invention may bind to a conformation of RANK-L in which it is bound to a pertinent ligand, may bind to a conformation of RANK-L in which it not bound to a pertinent ligand, or may bind to both such conformations (again with an affinity and/or specificity which may be the same or different). For example, the amino acid sequences and polypeptides of the invention may bind to a conformation of RANK-L in which it is bound to RANK, may bind to a conformation of RANK-L in which it not bound to RANK, or may bind to both such conformations (again with an affinity and/or specificity which may be the same or different). For example, the amino acid sequences and polypeptides of the invention may bind to a conformation of RANK-L in which it is bound to OPG, may bind to a conformation of RANK-L in which it not bound to OPG, or may bind to both such conformations (again with an affinity and/or specificity which may be the same or different).

RANK-L exists in a membrane bound and soluble form. The amino acid sequences and polypeptides of the invention may bind to either forms, or preferably the amino acid sequences and polypeptides of the invention may bind to both these forms. RANK-L exists in four different isoforms (see supra). The amino acid sequences and polypeptides of the invention may bind to either one of the four isoforms of RANK-L, or may bind to more than one such as two, three or all four isoforms of RANK-L.

It is also expected that the amino acid sequences and polypeptides of the invention will generally bind to all naturally occurring or synthetic analogs, variants, mutants, alleles, parts and fragments of RANK-L; or at least to those analogs, variants, mutants, alleles, parts and fragments of RANK-L that contain one or more antigenic determinants or epitopes that are essentially the same as the antigenic determinant(s) or epitope(s) to which the amino acid sequences and polypeptides of the invention bind in RANK-L (e.g. in wild-type RANK-L). Again, in such a case, the amino acid sequences and polypeptides of the invention may bind to such analogs, variants, mutants, alleles, parts and fragments with an affinity and/or specificity that are the same as, or that are different from (i.e. higher than or lower than), the affinity and specificity with which the amino acid sequences of the invention bind to (wild-type) RANK-L. It is also included within the scope of the invention that the amino acid sequences and polypeptides of the invention bind to some analogs, variants, mutants, alleles, parts and fragments of RANK-L, but not to others.

The amino acid sequences and polypeptides of the invention may bind to other, related TNF family members (e.g. TRAIL, TNF-alpha and/or CD40 ligand). In a preferred aspect, however, the amino acid sequences and polypeptides of the invention will have no detectable affinity for related TNF family members (i.e. an affinity which is more than 10 times, preferably more than 100 times, more preferably more than 1000 times lower than its affinity for RANK-L). In one aspect, the amino acid sequences and polypeptides of the invention will have no detectable affinity for TRAIL. In another aspect, the amino acid sequences and polypeptides of the invention will have no detectable affinity for TNF-alpha. In another aspect, the amino acid sequences and polypeptides of the invention will have no detectable affinity for CD40 ligand. In yet another aspect, the amino acid sequences and polypeptides of the invention will have no detectable affinity for TRAIL, TNF-alpha and/or CD40 ligand.

Similar to all known TNF cytokine family members, RANK-L self-assembles into noncovalently associated trimers. When RANK-L exists in a monomeric form and in one or more multimeric forms, it is within the scope of the invention that the amino acid sequences and polypeptides of the invention only bind to RANK-L in monomeric form, only bind to RANK-L in multimeric form, or bind to both the monomeric and the multimeric form. Again, in such a case, the amino acid sequences and polypeptides of the invention may bind to the monomeric form with an affinity and/or specificity that are the same as, or that are different from (i.e. higher than or lower than), the affinity and specificity with which the amino acid sequences of the invention bind to the multimeric form.

In one non-limiting aspect of the invention, the amino acid sequences and polypeptides of the invention bind to RANK-L such that the formation of the RANK-L trimer is prevented and/or inhibited.

It is accepted that RANK-L binds one receptor molecule (RANK) along each of the three clefts (or grooves) formed by neighboring monomers of the homotrimer. In this way, the RANK-L trimer exhibits three spatially distinct, but equivalent, intersubunit receptor-binding grooves into which three receptor molecules bind. Therefore, in order to inhibit the interaction between RANK-L and its receptors, therapeutic molecules should preferably target these intersubunit receptor binding grooves of RANK-L. NANOBODIES (as further defined herein) can show so-called cavity-binding properties (inter alia due to their extended CDR3 loop, compared to conventional $V_H$ domains) and are therefore ideally suited for inhibition of the interaction of RANK-L with its RANK receptor. Accordingly, in a preferred aspect, the amino acid sequences and polypeptides of the invention bind to the intersubunit receptor-binding grooves of RANK-L Also, when RANK-L can associate with other proteins or polypeptides to form protein complexes (e.g. with multiple subunits), it is within the scope of the invention that the amino acid sequences and polypeptides of the invention bind to RANK-L in its non-associated state, bind to RANK-L in its associated state, or bind to both. In all these cases, the amino acid sequences and polypeptides of the invention may bind to such multimers or associated protein complexes with an affinity and/or specificity that may be the same as or different from (i.e. higher than or lower than) the affinity and/or specificity with which the amino acid sequences and polypeptides of the invention bind to RANK-L in its monomeric and non-associated state.

Generally, amino acid sequences and polypeptides of the invention will at least bind to those forms of RANK-L (including monomeric, multimeric and associated forms) that are the most relevant from a biological and/or therapeutic point of view, as will be clear to the skilled person.

Also, generally, polypeptides of the invention that contain two or more amino acid sequences and/or NANOBODIES directed against RANK-L may bind with higher avidity than the corresponding monomeric amino acid sequences and/or NANOBODIES.

For example, and without limitation, a multivalent (as defined herein) protein or polypeptide that contains two or more amino acid sequences and/or NANOBODIES that are directed against different epitopes of RANK-L may bind to RANK-L with higher avidity than the corresponding monomers.

More importantly, a multivalent (as defined herein) protein or polypeptide that contains two or more amino acid sequences and/or NANOBODIES that are directed against RANK-L may (and usually will) bind with higher avidity to a multimer of RANK-L than to a monomer of RANK-L, and will usually also bind with higher avidity than the corresponding monomeric amino acid sequences and/or NANOBODIES. In such a multivalent protein or polypeptide, the two or more amino acid sequences and/or NANOBODIES may for example be directed against the same epitopes, substantially equivalent epitopes, or different epitopes. In one embodiment of such a multivalent protein or polypeptide, the two or more amino acid sequences and/or NANOBODIES may be the same (and therefore be directed against the same epitope).

The latter is of particular importance, as it is known that the primary mode of signal transduction by RANK-L involves binding of RANK receptors to a trimer of RANK-L molecules, which contains three receptor binding sites (see for example Lam et al. 2001, J. Clin. Invest. 108: 971-979).

In the present invention, it has been found that amino acid sequences and/or NANOBODIES are capable of binding to RANK-L in such a way that the activity of RANK-L is reduced, both in in vitro models and in cellular models (see the Experimental Section below). Although the invention is not limited to any specific mechanism, explanation or hypothesis, it is assumed that because of their small size and high affinity for RANK-L, two or three monovalent amino acid sequences and/or NANOBODIES of the invention are capable of simultaneously occupying two or three different receptor binding sites on the RANK-L trimer, thus preventing the trimer to initiate receptor binding and thereby to initiate signal transduction (however, other mechanisms of action are not excluded: for example, depending on the epitope against which it is directed, an amino acid sequence and/or NANOBODY of the invention may also inhibit the association of RANK-L into the trimeric state).

It should also be noted that, in addition or as an alternative to binding to two or more receptor binding sites on a single RANK-L trimer, the proteins or polypeptides of the present invention that comprises or essentially consists of two or more amino acid sequences and/or NANOBODIES that are directed against epitopes of RANK-L may bind (e.g. intermolecularly) epitopes on two separate RANK-L molecules (e.g. two separate trimers).

However, according to one particularly preferred embodiment, the invention relates to a protein or polypeptide that comprises or essentially consists of two or more amino acid sequences and/or NANOBODIES that are each directed against epitopes on RANK-L (and in particular on the RANK-L trimer) that lie in and/or form part of the receptor binding site(s) of the RANK-L trimer, such that said polypeptide, upon binding to a RANK-L trimer, is capable of inhibiting or reducing the RANK receptor binding that is mediated by said RANK-L trimer and/or the signal transduction that is mediated by such receptor binding.

In particular, according to this preferred embodiment, the invention relates to a protein or polypeptide that comprises or essentially consist of two or more amino acid sequences and/or NANOBODIES that are each directed against epitopes on RANK-L (and in particular on the RANK-L trimer) that lie in and/or form part of the receptor binding site(s) of the RANK-L trimer, wherein said amino acid sequences and/or NANOBODIES are linked to each other in such a way that the protein or polypeptide is capable of simultaneously binding to two or more receptor binding sites on a single RANK-L trimer (in other words, is capable of intramolecular binding to at least two RANK-L receptor binding sites on a RANK-L trimer). In this embodiment, the two or more amino acid sequences and/or NANOBODIES are preferably as defined above and are most preferably NANOBODIES (so that the protein or polypeptide is a multivalent NANOBODY construct, as further described herein). Also, in this embodiment, the two or more amino acid sequences and/or NANOBODIES may be the same or different; and may directed against different epitopes within the RANK receptor binding site(s), but are preferably directed against the same epitope. Some preferred, but non-limiting constructs of this embodiment of the invention are SEQ ID NO's: 622 to 693, 761 to 762 and 766 to 773.

In this embodiment of the invention, the two or more amino acid sequences and/or NANOBODIES will usually be linked via one or more suitable linkers, which linkers are such that each amino acid sequences and/or NANOBODIES can bind to a different receptor binding site on the same RANK-L trimer. Suitable linkers will inter alia depend on (the distance between) the epitopes on the RANK-L trimer to which the amino acid sequences and/or NANOBODIES bind, and will be clear to the skilled person based on the disclosure herein, optionally after some limited degree of routine experimentation. For example, when the two or more amino acid sequences are (single) domain antibodies or NANOBODIES, suitable linkers may be chosen from the linkers described herein, but with a linker length that is such that the two or more (single) domain antibodies or NANOBODIES can each bind to a different receptor binding site on the same RANK-L trimer.

Also, when the two or more amino acid sequences that bind to the receptor binding sites of RANK-L are (single) domain antibodies or NANOBODIES, they may also be linked to each other via a third (single) domain antibody or NANOBODY (in which the two or more (single) domain antibodies or NANOBODIES may be linked directly to the third (single) domain antibody/NANOBODY or via suitable linkers). Such a third (single) domain antibody or NANOBODY may for example be a (single) domain antibody or NANOBODY that provides for an increased half-life, as further described herein. For example, the latter (single) domain antibody or NANOBODY may be a (single) domain antibody or NANOBODY that is capable of binding to a (human) serum protein such as (human) serum albumin, as further described herein. Some non-limiting examples of such constructs are the constructs of SEQ ID NO's: 694-729 and 759-760. Such a third (single) domain antibody or NANOBODY may for example be a (single) domain antibody or NANOBODY that is directed against and/or can bind another epitope on RANK-L, providing a biparatopic (single) domain antibody or NANOBODIES, as is further described herein.

Alternatively, the two or more amino acid sequences and/or NANOBODIES that bind to the receptor binding site(s) of RANK-L may be linked in series (either directly or via a suitable linker) and the third (single) domain antibody or NANOBODY (which may provide for increased half-life or which may bind another epitope on RANK-L, as described above) may be connected directly or via a linker to one of these two or more aforementioned amino acid sequences and/or NANOBODIES.

More generally, the distance between the two or more amino acid sequences and/or NANOBODIES should be such that it allows the protein or polypeptide to undergo intramolecular binding to the RANK-L trimer (i.e. instead of intermolecular binding). The distance between the N-terminus and the C-terminus of two anti-RANK-L amino acid sequences and/or NANOBODIES can be determined by any suitable means, such as by crystallography or molecular modelling (as described, for example, by Lam et al. 2001, J. Clin. Invest. 108: 971-979). These techniques generally also make it possible to determine whether a specific multivalent or multispecific protein or polypeptide is capable of providing intramolecular modelling. Alternatively, size-exclusion chromatography (as described by Santora et al., Anal. Biochem., 299: 119-129) could be used to determine whether a given protein or polypeptide of the invention will (predominantly) provide intramolecular binding to a RANK-L trimer or (predominantly) intermolecular binding between two or more RANK-L trimers. Thus, in one particular embodiment of the invention, a protein or polypeptide of the invention is preferably such that, in this experiment, it predominantly or essentially exclusively leads to intramolecular binding. However, as emphasized above, it should be noted that proteins or polypeptides of the invention that operate via intermolecular binding of separate RANK-L molecules (e.g. trimers) are also within the scope of the present invention.

Thus, in another preferred aspect, the invention provides for a multivalent or multispecific protein or polypeptide that comprises at least two amino acid sequences and/or NANOBODIES against RANK-L (and in particular of the RANK-L trimer), in which said at least two amino acid sequences and/or NANOBODIES are linked in such a way that the distance between the N-terminus and the C-terminus of the at least two anti-RANK-L amino acid sequences and/or NANOBODIES is such that the protein or polypeptide is capable of undergoing intramolecular binding (as described herein) with a RANK-L trimer.

In such a preferred protein or polypeptide, the two or more amino acid sequences and/or NANOBODIES may be linked in any suitable fashion, as long as the preferred distance between the N-terminus and the C-terminus of the at least two anti-RANK-L amino acid sequences and/or NANOBODIES can be achieved, and/or as long as the protein or polypeptide is capable of undergoing intramolecular binding (as described herein) with a RANK-L trimer.

For example, in its simplest form, the at least two amino acid sequences and/or NANOBODIES are directly linked via a suitable linker or spacer that provides for the preferred distance between the N-terminus and the C-terminus of the at least two anti-RANK-L amino acid sequences and/or NANOBODIES and which may allow the protein or polypeptide to undergo intramolecular binding (as described herein) with a RANK-L trimer. Suitable linkers are described herein, and may—for example and without limitation—comprise an amino acid sequence, which amino acid sequence preferably has a length of from 1 up to 50 or more amino acids, more preferably from 5 to 30 amino acids, such as about 9 to 20 amino acids. Preferably, such an amino acid sequence should also be such that it allows the protein or polypeptide to undergo intramolecular binding (as described herein) with a RANK-L trimer.

Thus, in another preferred aspect, the invention provides for a multivalent or multispecific protein or polypeptide that comprises at least two amino acid sequences and/or NANOBODIES against RANK-L (and in particular the RANK-L trimer), in which said amino acid sequences and/or NANOBODIES are preferably directly linked to each other using a suitable linker or spacer such that the distance between the N-terminus and the C-terminus of the at least two anti-RANK-L amino acid sequences and/or NANOBODIES is such that the protein or polypeptide is capable of undergoing intramolecular binding (as described herein) with a RANK-L trimer.

More preferably, in this preferred aspect, the linker or spacer is an amino acid sequence that preferably has a length of from 1 up to 50 or more amino acids, more preferably from 5 to 30 amino acids, such as about 9 to 20 amino acids. In one preferred, but non-limiting embodiment, the linker essentially consists of glycine and serine residues (as further described below). For example, one suitable linker is the GS9 linker described herein, which comprises 9 amino acid residues, the GS15 linker described herein, which comprises 15 amino acid residues, the GS20 linker described herein, which comprises 20 amino acid residues and the GS30 linker described herein, which comprises 30 amino acid residues.

In another embodiment, the at least two amino acid sequences and/or NANOBODIES against RANK-L are linked to each other via another moiety (optionally via one or two linkers), such as another protein or polypeptide. In this embodiment, it may be desirable to have the preferred distance (i.e. as mentioned above) between the N-terminus and the C-terminus of the at least two anti-RANK-L amino acid sequences and/or NANOBODIES, for example such that the protein or polypeptide can still undergo intramolecular binding (as described herein) with a RANK-L trimer. In this embodiment, the at least two amino acid sequences and/or NANOBODIES may be linked directly to the other moiety, or using a suitable linker or spacer, again as long as the preferred distance and/or desired intramolecular binding can still be achieved. The moiety may be any suitable moiety which does not detract (too much) from the binding of the protein or polypeptide to RANK-L and/or from the further desired biological or pharmacological properties of the protein or polypeptide. As such, the moiety may be essentially inactive or may be biologically active, and as such may or may not improve the desired properties of the protein or polypeptide and/or may confer one or more additional desired properties to the protein or polypeptide. For example, and without limitation, the moiety may improve the half-life of the protein or polypeptide, and/or may reduce its immunogenicity or improve any other desired property. In one preferred embodiment, the moiety may be another amino acid sequences and/or NANOBODY (including but not limited to a third amino acid sequences and/or NANO-BODY against RANK-L, although this is not necessary and usually less preferred), and in particular another amino acid sequences and/or NANOBODY that improves the half-life of the protein or polypeptide, such as an amino acid sequences and/or NANOBODY that is directed against a serum protein, for example against human serum albumin. Examples of such proteins and polypeptides are described herein.

Thus, in one embodiment, the invention relates to a multivalent multispecific construct comprising two or more amino acid sequences and/or NANOBODIES that are each directed against epitopes on RANK-L (e.g. on the RANK-L trimer) that lie in and/or form part of the receptor binding site, and that are linked to each other via at least one amino acid sequences and/or NANOBODY that provides for increased half-life (and optionally via one or more suitable linkers), such that said polypeptide, upon binding to a RANK-L trimer, is capable inhibiting or reducing the RANK receptor binding and/or the signal transduction that is mediated by said RANK-L trimer. Such a polypeptide may be such that said firstmentioned two or more amino acid sequences and/or NANOBODIES can each bind to a different receptor binding site on a RANK-L trimer.

In particular, in this embodiment, the polypeptide may comprise a trivalent bispecific NANOBODY, that comprises two NANOBODIES that are each directed against epitopes on RANK-L (and in particular of the RANK-L trimer) that lie in and/or form part of the receptor binding site, in which said NANOBODIES are linked to each other via a third NANOBODY that provides for an increased half-life (e.g. a NANOBODY that is directed to a serum protein such as human serum albumin), in which each of the firstmentioned two NANOBODIES may be directly linked to said third NANOBODY or via one or more suitable linkers, such that said polypeptide, upon binding to a RANK-L trimer, is capable of inhibiting or reducing the RANK receptor binding and/or the signal transduction that is mediated by said RANK-L trimer. Such a polypeptide may be such that said firstmentioned two NANOBODIES can each bind to a different receptor binding site on a RANK-L trimer. Again, some particularly preferred NANOBODIES for use in this embodiment of the invention are presented in SEQ ID NO's: 560 to 621, as well as humanized and other variants thereof (such as e.g. SEQ ID NO's: 730 to 757 and 765); and the NANOBODIES directed against human serum albumin described herein. Some preferred, but non-limiting constructs of this embodiment of the invention are SEQ ID NO's: 694 to 729 and 759 to 760.

It is also within the scope of the invention to use parts, fragments, analogs, mutants, variants, alleles and/or derivatives of the amino acid sequences and polypeptides of the invention, and/or to use proteins or polypeptides comprising or essentially consisting of one or more of such parts, fragments, analogs, mutants, variants, alleles and/or derivatives, as long as these are suitable for the uses envisaged herein. Such parts, fragments, analogs, mutants, variants, alleles and/or derivatives will usually contain (at least part of) a functional antigen-binding site for binding against RANK-L; and more preferably will be capable of specific binding to RANK-L, and even more preferably capable of binding to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Some non-limiting examples of such parts, fragments, analogs, mutants, variants, alleles, derivatives, proteins and/or polypeptides will become clear from the further description herein. Additional fragments or polypeptides of the invention may also be provided by suitably combining (i.e. by linking or genetic fusion) one or more (smaller) parts or fragments as described herein.

In one specific, but non-limiting aspect of the invention, which will be further described herein, such analogs, mutants, variants, alleles, derivatives have an increased half-life in serum (as further described herein) compared to the amino acid sequence from which they have been derived. For example, an amino acid sequence of the invention may be linked (chemically or otherwise) to one or more groups or moieties that extend the half-life (such as PEG), so as to provide a derivative of an amino acid sequence of the invention with increased half-life.

In one specific, but non-limiting aspect, the amino acid sequence of the invention may be an amino acid sequence that comprises an immunoglobulin fold or may be an amino acid sequence that, under suitable conditions (such as physiological conditions) is capable of forming an immunoglobulin fold (i.e. by folding). Reference is inter alia made to the review by Halaby et al., J. (1999) Protein Eng. 12, 563-71. Preferably, when properly folded so as to form an immunoglobulin fold, such an amino acid sequence is capable of specific binding (as defined herein) to RANK-L; and more preferably capable of binding to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein. Also, parts, fragments, analogs, mutants, variants, alleles and/or derivatives of such amino acid sequences are preferably such that they comprise an immunoglobulin fold or are capable for forming, under suitable conditions, an immunoglobulin fold.

In particular, but without limitation, the amino acid sequences of the invention may be amino acid sequences that essentially consist of 4 framework regions (FR1 to FR4 respectively) and 3 complementarity determining regions (CDR1 to CDR3 respectively); or any suitable fragment of such an amino acid sequence (which will then usually contain at least some of the amino acid residues that form at least one of the CDR's, as further described herein).

The amino acid sequences of the invention may in particular be an immunoglobulin sequence or a suitable fragment thereof, and more in particular be an immunoglobulin variable domain sequence or a suitable fragment thereof, such as light chain variable domain sequence (e.g. a $V_L$-sequence) or a suitable fragment thereof; or a heavy chain variable domain sequence (e.g. a $V_H$-sequence) or a suitable fragment thereof. When the amino acid sequence of the invention is a heavy chain variable domain sequence, it may be a heavy chain variable domain sequence that is derived from a conventional four-chain antibody (such as, without limitation, a $V_H$ sequence that is derived from a human antibody) or be a so-called $V_{HH}$-sequence (as defined herein) that is derived from a so-called "heavy chain antibody" (as defined herein).

However, it should be noted that the invention is not limited as to the origin of the amino acid sequence of the invention (or of the nucleotide sequence of the invention used to express it), nor as to the way that the amino acid sequence or nucleotide sequence of the invention is (or has been) generated or obtained. Thus, the amino acid sequences of the invention may be naturally occurring amino acid sequences (from any suitable species) or synthetic or semi-synthetic amino acid sequences. In a specific but non-limiting aspect of the invention, the amino acid sequence is a naturally occurring immunoglobulin sequence (from any suitable species) or a synthetic or semi-synthetic immunoglobulin sequence, including but not limited to "humanized" (as defined herein) immunoglobulin sequences (such as partially or fully humanized mouse or rabbit immunoglobulin sequences, and in particular partially or fully humanized $V_{HH}$ sequences or NANOBODIES), "camelized" (as defined herein) immunoglobulin sequences, as well as immunoglobulin sequences that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing. Reference is for example made to the standard handbooks, as well as to the further description and prior art mentioned herein.

Similarly, the nucleotide sequences of the invention may be naturally occurring nucleotide sequences or synthetic or semi-synthetic sequences, and may for example be sequences that are isolated by PCR from a suitable naturally occurring template (e.g. DNA or RNA isolated from a cell), nucleotide sequences that have been isolated from a library (and in particular, an expression library), nucleotide sequences that have been prepared by introducing mutations into a naturally occurring nucleotide sequence (using any suitable technique known per se, such as mismatch PCR), nucleotide sequence that have been prepared by PCR using overlapping primers, or nucleotide sequences that have been prepared using techniques for DNA synthesis known per se.

The amino acid sequence of the invention may in particular be a domain antibody (or an amino acid sequence that is suitable for use as a domain antibody), a single domain antibody (or an amino acid sequence that is suitable for use as a single domain antibody), a "dAb" (or an amino acid sequence that is suitable for use as a dAb) or a NANOBODY (as defined herein, and including but not limited to a $V_{HH}$ sequence); other single variable domains, or any suitable fragment of any one thereof. For a general description of (single) domain antibodies, reference is also made to the prior art cited above, as well as to EP 0 368 684. For the term "dAb's", reference is for example made to Ward et al. (Nature 1989 Oct. 12; 341 (6242): 544-6), to Holt et al., Trends Biotechnol., 2003, 21(11):484-490; as well as to for example WO 06/030220, WO 06/003388 and other published patent applications of Domantis Ltd. It should also be noted that, although less preferred in the context of the present invention because they are not of mammalian origin, single domain antibodies or single variable domains can be derived from certain species of shark (for example, the so-called "IgNAR domains", see for example WO 05/18629).

In particular, the amino acid sequence of the invention may be a NANOBODY® (as defined herein) or a suitable fragment thereof. [Note: NANOBODY®, NANOBODIES® and NANOCLONE® are registered trademarks of Ablynx N.V.] Such NANOBODIES directed against RANK-L will also be referred to herein as "NANOBODIES of the invention".

For a general description of NANOBODIES, reference is made to the further description below, as well as to the prior art cited herein. In this respect, it should however be noted that this description and the prior art mainly described NANOBODIES of the so-called "$V_H3$ class" (i.e. NANOBODIES with a high degree of sequence homology to human germline sequences of the $V_H3$ class such as DP-47, DP-51 or DP-29), which NANOBODIES form a preferred aspect of this invention. It should however be noted that the invention in its broadest sense generally covers any type of NANOBODY directed against RANK-L, and for example also covers the NANOBODIES belonging to the so-called "V$_H$4 class" (i.e. NANOBODIES with a high degree of sequence homology to human germline sequences of the V$_H$4 class such as DP-78), as for example described in WO 07/118670.

Generally, NANOBODIES (in particular V$_{HH}$ sequences and partially humanized NANOBODIES) can in particular be characterized by the presence of one or more "Hallmark residues" (as described herein) in one or more of the framework sequences (again as further described herein).

Thus, generally, a NANOBODY can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which one or more of the Hallmark residues are as further defined herein.

In particular, a NANOBODY can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which the framework sequences are as further defined herein.

More in particular, a NANOBODY can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) preferably one or more of the amino acid residues at positions 11, 37, 44, 45, 47, 83, 84, 103, 104 and 108 according to the Kabat numbering are chosen from the Hallmark residues mentioned in Table A-3 below;

and in which:

ii) said amino acid sequence has at least 80% amino acid identity with at least one of the amino acid sequences of SEQ ID NO's: 1 to 22, in which for the purposes of determining the degree of amino acid identity, the amino acid residues that form the CDR sequences (indicated with X in the sequences of SEQ ID NO's: 1 to 22) are disregarded.

In these NANOBODIES, the CDR sequences are generally as further defined herein.

Thus, the invention also relates to such NANOBODIES that can bind to (as defined herein) and/or are directed against RANK-L, to suitable fragments thereof, as well as to polypeptides that comprise or essentially consist of one or more of such NANOBODIES and/or suitable fragments.

SEQ ID NO's: 560-621 give the amino acid sequences of a number of V$_{HH}$ sequences that have been raised against RANK-L.

In particular, the invention in some specific aspects provides:

amino acid sequences that are directed against (as defined herein) RANK-L and that have at least 80%, preferably at least 85%, such as 90% or 95% or more sequence identity with at least one of the amino acid sequences of SEQ ID NO's: 560-621. These amino acid sequences may further be such that they neutralize binding of RANK or OPG to RANK-L; and/or compete with RANK or OPG for binding to RANK-L; and/or are directed against an interaction site (as defined herein) on RANK-L (such as the RANK or OPG binding site);

amino acid sequences that cross-block (as defined herein) the binding of at least one of the amino acid sequences of SEQ ID NO's: 560-621 to RANK-L and/or that compete with at least one of the amino acid sequences of SEQ ID NO's: 560-621 for binding to RANK-L. Again, these amino acid sequences may further be such that they neutralize binding of the cognate ligand to RANK-L; and/or compete with the cognate ligand for binding to RANK-L; and/or are directed against an interaction site (as defined herein) on RANK-L (such as the RANK or OPG binding site);

which amino acid sequences may be as further described herein (and may for example be NANOBODIES); as well as polypeptides of the invention that comprise one or more of such amino acid sequences (which may be as further described herein, and may for example be bispecific and/or biparatopic polypeptides as described herein), and nucleic acid sequences that encode such amino acid sequences and polypeptides. Such amino acid sequences and polypeptides do not include any naturally occurring ligands.

Accordingly, some particularly preferred NANOBODIES of the invention are NANOBODIES which can bind (as further defined herein) to and/or are directed against to RANK-L and which:

i) have at least 80% amino acid identity with at least one of the amino acid sequences of SEQ ID NO's: 560-621, in which for the purposes of determining the degree of amino acid identity, the amino acid residues that form the CDR sequences are disregarded. In this respect, reference is also made to Table A-1, which lists the framework 1 sequences (SEQ ID NO's: 126-187), framework 2 sequences (SEQ ID NO's: 250-311), framework 3 sequences (SEQ ID NO's: 374-435) and framework 4 sequences (SEQ ID NO's: 498-559) of the NANOBODIES of SEQ ID NO's: 560-621 (with respect to the amino acid residues at positions 1 to 4 and 27 to 30 of the framework 1 sequences, reference is also made to the comments made below. Thus, for determining the degree of amino acid identity, these residues are preferably disregarded);

and in which:

ii) preferably one or more of the amino acid residues at positions 11, 37, 44, 45, 47, 83, 84, 103, 104 and 108 according to the Kabat numbering are chosen from the Hallmark residues mentioned in Table A-3 below.

In these NANOBODIES, the CDR sequences are generally as further defined herein.

Again, such NANOBODIES may be derived in any suitable manner and from any suitable source, and may for example be naturally occurring V$_{HH}$ sequences (i.e. from a suitable species of Camelid) or synthetic or semi-synthetic amino acid sequences, including but not limited to "humanized" (as defined herein) NANOBODIES, "camelized" (as defined herein) immunoglobulin sequences (and in particular camelized heavy chain variable domain sequences), as well as NANOBODIES that have been obtained by techniques such as affinity maturation (for example, starting from synthetic, random or naturally occurring immunoglobulin sequences), CDR grafting, veneering, combining fragments derived from different immunoglobulin sequences, PCR assembly using overlapping primers, and similar techniques for engineering immunoglobulin sequences well known to the skilled person; or any suitable combination of any of the foregoing as further described herein. Also, when a NANOBODY comprises a $V_{HH}$ sequence, said NANOBODY may be suitably humanized, as further described herein, so as to provide one or more further (partially or fully) humanized NANOBODIES of the invention. Similarly, when a NANOBODY comprises a synthetic or semi-synthetic sequence (such as a partially humanized sequence), said NANOBODY may optionally be further suitably humanized, again as described herein, again so as to provide one or more further (partially or fully) humanized NANOBODIES of the invention.

In particular, humanized NANOBODIES may be amino acid sequences that are as generally defined for NANOBODIES in the previous paragraphs, but in which at least one amino acid residue is present (and in particular, in at least one of the framework residues) that is and/or that corresponds to a humanizing substitution (as defined herein). Some preferred, but non-limiting humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a NANOBODY may be partially humanized or fully humanized.

Some particularly preferred humanized NANOBODIES of the invention are humanized variants of the NANOBODIES of SEQ ID NO's: 560-621, of which the amino acid sequences of SEQ ID NO's: 730-757 and 765 are some especially preferred examples.

Thus, some other preferred NANOBODIES of the invention are NANOBODIES which can bind (as further defined herein) to RANK-L and which:
i) are a humanized variant of one of the amino acid sequences of SEQ ID NO's: 560-621; and/or
ii) have at least 80% amino acid identity with at least one of the amino acid sequences of SEQ ID NO's: 560-621 and/or at least one of the amino acid sequences of SEQ ID NO's: 730-757 and 765, in which for the purposes of determining the degree of amino acid identity, the amino acid residues that form the CDR sequences are disregarded;
and in which:
i) preferably one or more of the amino acid residues at positions 11, 37, 44, 45, 47, 83, 84, 103, 104 and 108 according to the Kabat numbering are chosen from the Hallmark residues mentioned in Table A-3 below.

According to another specific aspect of the invention, the invention provides a number of stretches of amino acid residues (i.e. small peptides) that are particularly suited for binding to RANK-L. These stretches of amino acid residues may be present in, and/or may be incorporated into, an amino acid sequence of the invention, in particular in such a way that they form (part of) the antigen binding site of an amino acid sequence of the invention. As these stretches of amino acid residues were first generated as CDR sequences of heavy chain antibodies or $V_{HH}$ sequences that were raised against RANK-L (or may be based on and/or derived from such CDR sequences, as further described herein), they will also generally be referred to herein as "CDR sequences" (i.e. as CDR1 sequences, CDR2 sequences and CDR3 sequences, respectively). It should however be noted that the invention in its broadest sense is not limited to a specific structural role or function that these stretches of amino acid residues may have in an amino acid sequence of the invention, as long as these stretches of amino acid residues allow the amino acid sequence of the invention to bind to RANK-L. Thus, generally, the invention in its broadest sense comprises any amino acid sequence that is capable of binding to RANK-L and that comprises one or more CDR sequences as described herein, and in particular a suitable combination of two or more such CDR sequences, that are suitably linked to each other via one or more further amino acid sequences, such that the entire amino acid sequence forms a binding domain and/or binding unit that is capable of binding to RANK-L. It should however also be noted that the presence of only one such CDR sequence in an amino acid sequence of the invention may by itself already be sufficient to provide an amino acid sequence of the invention that is capable of binding to RANK-L; reference is for example again made to the so-called "Expedite fragments" described in WO 03/050531.

Thus, in another specific, but non-limiting aspect, the amino acid sequence of the invention may be an amino acid sequence that comprises at least one amino acid sequence that is chosen from the group consisting of the CDR1 sequences, CDR2 sequences and CDR3 sequences that are described herein (or any suitable combination thereof). In particular, an amino acid sequence of the invention may be an amino acid sequence that comprises at least one antigen binding site, wherein said antigen binding site comprises at least one amino acid sequence that is chosen from the group consisting of the CDR1 sequences, CDR2 sequences and CDR3 sequences that are described herein (or any suitable combination thereof).

Generally, in this aspect of the invention, the amino acid sequence of the invention may be any amino acid sequence that comprises at least one stretch of amino acid residues, in which said stretch of amino acid residues has an amino acid sequence that corresponds to the sequence of at least one of the CDR sequences described herein. Such an amino acid sequence may or may not comprise an immunoglobulin fold. For example, and without limitation, such an amino acid sequence may be a suitable fragment of an immunoglobulin sequence that comprises at least one such CDR sequence, but that is not large enough to form a (complete) immunoglobulin fold (reference is for example again made to the "Expedite fragments" described in WO 03/050531). Alternatively, such an amino acid sequence may be a suitable "protein scaffold" that comprises least one stretch of amino acid residues that corresponds to such a CDR sequence (i.e. as part of its antigen binding site). Suitable scaffolds for presenting amino acid sequences will be clear to the skilled person, and for example comprise, without limitation, to binding scaffolds based on or derived from immunoglobulins (i.e. other than the immunoglobulin sequences already described herein), protein scaffolds derived from protein A domains (such as Affibodies™), tendamistat, fibronectin, lipocalin, CTLA-4, T-cell receptors, designed ankyrin repeats, avimers and PDZ domains (Binz et al., Nat. Biotech 2005, Vol 23:1257), and binding moieties based on DNA or RNA including but not limited to DNA or RNA aptamers (Ulrich et al., Comb Chem High Throughput Screen 2006 9(8):619-32).

Again, any amino acid sequence of the invention that comprises one or more of these CDR sequences is preferably such that it can specifically bind (as defined herein) to RANK-L, and more in particular such that it can bind to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein), that is as defined herein.

More in particular, the amino acid sequences according to this aspect of the invention may be any amino acid sequence that comprises at least one antigen binding site, wherein said antigen binding site comprises at least two amino acid sequences that are chosen from the group consisting of the CDR1 sequences described herein, the CDR2 sequences described herein and the CDR3 sequences described herein, such that (i) when the first amino acid sequence is chosen from the CDR1 sequences described herein, the second amino acid sequence is chosen from the CDR2 sequences described herein or the CDR3 sequences described herein; (ii) when the first amino acid sequence is chosen from the CDR2 sequences described herein, the second amino acid sequence is chosen from the CDR1 sequences described herein or the CDR3 sequences described herein; or (iii) when the first amino acid sequence is chosen from the CDR3 sequences described herein, the second amino acid sequence is chosen from the CDR1 sequences described herein or the CDR3 sequences described herein.

Even more in particular, the amino acid sequences of the invention may be amino acid sequences that comprise at least one antigen binding site, wherein said antigen binding site comprises at least three amino acid sequences that are chosen from the group consisting of the CDR1 sequences described herein, the CDR2 sequences described herein and the CDR3 sequences described herein, such that the first amino acid sequence is chosen from the CDR1 sequences described herein, the second amino acid sequence is chosen from the CDR2 sequences described herein, and the third amino acid sequence is chosen from the CDR3 sequences described herein. Preferred combinations of CDR1, CDR2 and CDR3 sequences will become clear from the further description herein. As will be clear to the skilled person, such an amino acid sequence is preferably an immunoglobulin sequence (as further described herein), but it may for example also be any other amino acid sequence that comprises a suitable scaffold for presenting said CDR sequences.

Thus, in one specific, but non-limiting aspect, the invention relates to an amino acid sequence directed against RANK-L, that comprises one or more stretches of amino acid residues chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497;
or any suitable combination thereof.

When an amino acid sequence of the invention contains one or more amino acid sequences according to b) and/or c):
i) any amino acid substitution in such an amino acid sequence according to b) and/or c) is preferably, and compared to the corresponding amino acid sequence according to a), a conservative amino acid substitution, (as defined herein);
and/or
ii) the amino acid sequence according to b) and/or c) preferably only contains amino acid substitutions, and no amino acid deletions or insertions, compared to the corresponding amino acid sequence according to a);
and/or
iii) the amino acid sequence according to b) and/or c) may be an amino acid sequence that is derived from an amino acid sequence according to a) by means of affinity maturation using one or more techniques of affinity maturation known per se.

Similarly, when an amino acid sequence of the invention contains one or more amino acid sequences according to e) and/or f):
i) any amino acid substitution in such an amino acid sequence according to e) and/or f) is preferably, and compared to the corresponding amino acid sequence according to d), a conservative amino acid substitution, (as defined herein);
and/or
ii) the amino acid sequence according to e) and/or f) preferably only contains amino acid substitutions, and no amino acid deletions or insertions, compared to the corresponding amino acid sequence according to d);
and/or
iii) the amino acid sequence according to e) and/or f) may be an amino acid sequence that is derived from an amino acid sequence according to d) by means of affinity maturation using one or more techniques of affinity maturation known per se.

Also, similarly, when an amino acid sequence of the invention contains one or more amino acid sequences according to h) and/or i):
i) any amino acid substitution in such an amino acid sequence according to h) and/or i) is preferably, and compared to the corresponding amino acid sequence according to g), a conservative amino acid substitution, (as defined herein);
and/or
ii) the amino acid sequence according to h) and/or i) preferably only contains amino acid substitutions, and no amino acid deletions or insertions, compared to the corresponding amino acid sequence according to g);
and/or
iii) the amino acid sequence according to h) and/or i) may be an amino acid sequence that is derived from an amino acid sequence according to g) by means of affinity maturation using one or more techniques of affinity maturation known per se.

It should be understood that the last preceding paragraphs also generally apply to any amino acid sequences of the invention that comprise one or more amino acid sequences according to b), c), e), f), h) or i), respectively.

In this specific aspect, the amino acid sequence preferably comprises one or more stretches of amino acid residues chosen from the group consisting of:
i) the amino acid sequences of SEQ ID NO's: 188-249;
ii) the amino acid sequences of SEQ ID NO's: 312-373 and 758; and
iii) the amino acid sequences of SEQ ID NO's: 436-497;
or any suitable combination thereof.

Also, preferably, in such an amino acid sequence, at least one of said stretches of amino acid residues forms part of the antigen binding site for binding against RANK-L.

In a more specific, but again non-limiting aspect, the invention relates to an amino acid sequence directed against RANK-L, that comprises two or more stretches of amino acid residues chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497;
such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).

In this specific aspect, the amino acid sequence preferably comprises two or more stretches of amino acid residues chosen from the group consisting of:
i) the amino acid sequences of SEQ ID NO's: 188-249;
ii) the amino acid sequences of SEQ ID NO's: 312-373 and 758; and
iii) the amino acid sequences of SEQ ID NO's: 436-497;
such that, (i) when the first stretch of amino acid residues corresponds to one of the amino acid sequences of SEQ ID NO's: 188-249, the second stretch of amino acid residues corresponds to one of the amino acid sequences of SEQ ID NO's: 312-373 and 758 or of SEQ ID NO's: 436-497; (ii) when the first stretch of amino acid residues corresponds to one of the amino acid sequences of SEQ ID NO's: 312-373 and 758, the second stretch of amino acid residues corresponds to one of the amino acid sequences of SEQ ID NO's: 188-249 or of SEQ ID NO's: 436-497; or (iii) when the first stretch of amino acid residues corresponds to one of the amino acid sequences of SEQ ID NO's: 436-497, the second stretch of amino acid residues corresponds to one of the amino acid sequences of SEQ ID NO's: 188-249 or of SEQ ID NO's: 312-373 and 758.

Also, in such an amino acid sequence, the at least two stretches of amino acid residues again preferably form part of the antigen binding site for binding against RANK-L.

In an even more specific, but non-limiting aspect, the invention relates to an amino acid sequence directed against RANK-L, that comprises three or more stretches of amino acid residues, in which the first stretch of amino acid residues is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
the second stretch of amino acid residues is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and the third stretch of amino acid residues is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497.

Preferably, in this specific aspect, the first stretch of amino acid residues is chosen from the group consisting of the amino acid sequences of SEQ ID NO's: 188-249; the second stretch of amino acid residues is chosen from the group consisting of the amino acid sequences of SEQ ID NO's: 312-373 and 758; and the third stretch of amino acid residues is chosen from the group consisting of the amino acid sequences of SEQ ID NO's: 436-497.

Again, preferably, in such an amino acid sequence, the at least three stretches of amino acid residues forms part of the antigen binding site for binding against RANK-L.

Preferred combinations of such stretches of amino acid sequences will become clear from the further disclosure herein.

Preferably, in such amino acid sequences the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 560-621. This degree of amino acid identity can for example be determined by determining the degree of amino acid identity (in a manner described herein) between said amino acid sequence and one or more of the sequences of SEQ ID NO's: 560-621, in which the amino acid residues that form the framework regions are disregarded. Also, such amino acid sequences of the invention can be as further described herein.

Also, such amino acid sequences are preferably such that they can specifically bind (as defined herein) to RANK-L; and more in particular bind to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

When the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
and/or
CDR2 is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and/or
CDR3 is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497.

In particular, such an amino acid sequence of the invention may be such that CDR1 is chosen from the group consisting of the amino acid sequences of SEQ ID NO's: 188-249; and/or CDR2 is chosen from the group consisting of the amino acid sequences of SEQ ID NO's: 312-373 and 758; and/or CDR3 is chosen from the group consisting of the amino acid sequences of SEQ ID NO's: 436-497.

In particular, when the amino acid sequence of the invention essentially consists of 4 framework regions (FR1 to FR4, respectively) and 3 complementarity determining regions (CDR1 to CDR3, respectively), the amino acid sequence of the invention is preferably such that:

CDR1 is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
and
CDR2 is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and
CDR3 is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497; or any suitable fragment of such an amino acid sequence.

In particular, such an amino acid sequence of the invention may be such that CDR1 is chosen from the group consisting of the amino acid sequences of SEQ ID NO's: 188-249; and CDR2 is chosen from the group consisting of the amino acid sequences of SEQ ID NO's: 312-373 and 758; and CDR3 is chosen from the group consisting of the amino acid sequences of SEQ ID NO's: 436-497.

Again, preferred combinations of CDR sequences will become clear from the further description herein.

Also, such amino acid sequences are preferably such that they can specifically bind (as defined herein) to RANK-L; and more in particular bind to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In one preferred, but non-limiting aspect, the invention relates to an amino acid sequence that essentially consists of 4 framework regions (FR1 to FR4, respectively) and 3 complementarity determining regions (CDR1 to CDR3, respectively), in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 560-621. This degree of amino acid identity can for example be determined by determining the degree of amino acid identity (in a manner described herein) between said amino acid sequence and one or more of the sequences of SEQ ID NO's: 560-621, in which the amino acid residues that form the framework regions are disregarded. Such amino acid sequences of the invention can be as further described herein.

In such an amino acid sequence of the invention, the framework sequences may be any suitable framework sequences, and examples of suitable framework sequences will be clear to the skilled person, for example on the basis the standard handbooks and the further disclosure and prior art mentioned herein.

The framework sequences are preferably (a suitable combination of) immunoglobulin framework sequences or framework sequences that have been derived from immunoglobulin framework sequences (for example, by humanization or camelization). For example, the framework sequences may be framework sequences derived from a light chain variable domain (e.g. a $V_L$-sequence) and/or from a heavy chain variable domain (e.g. a $V_H$-sequence). In one particularly preferred aspect, the framework sequences are either framework sequences that have been derived from a $V_{HH}$-sequence (in which said framework sequences may optionally have been partially or fully humanized) or are conventional V$_H$ sequences that have been camelized (as defined herein).

The framework sequences are preferably such that the amino acid sequence of the invention is a domain antibody (or an amino acid sequence that is suitable for use as a domain antibody); is a single domain antibody (or an amino acid sequence that is suitable for use as a single domain antibody); is a "dAb" (or an amino acid sequence that is suitable for use as a dAb); or is a NANOBODY™ (including but not limited to V$_{HH}$ sequence). Again, suitable framework sequences will be clear to the skilled person, for example on the basis the standard handbooks and the further disclosure and prior art mentioned herein.

In particular, the framework sequences present in the amino acid sequences of the invention may contain one or more of Hallmark residues (as defined herein), such that the amino acid sequence of the invention is a NANOBODY. Some preferred, but non-limiting examples of (suitable combinations of) such framework sequences will become clear from the further disclosure herein.

Again, as generally described herein for the amino acid sequences of the invention, it is also possible to use suitable fragments (or combinations of fragments) of any of the foregoing, such as fragments that contain one or more CDR sequences, suitably flanked by and/or linked via one or more framework sequences (for example, in the same order as these CDR's and framework sequences may occur in the full-sized immunoglobulin sequence from which the fragment has been derived). Such fragments may also again be such that they comprise or can form an immunoglobulin fold, or alternatively be such that they do not comprise or cannot form an immunoglobulin fold.

In one specific aspect, such a fragment comprises a single CDR sequence as described herein (and in particular a CDR3 sequence), that is flanked on each side by (part of) a framework sequence (and in particular, part of the framework sequence(s) that, in the immunoglobulin sequence from which the fragment is derived, are adjacent to said CDR sequence. For example, a CDR3 sequence may be preceded by (part of) a FR3 sequence and followed by (part of) a FR4 sequence). Such a fragment may also contain a disulphide bridge, and in particular a disulphide bridge that links the two framework regions that precede and follow the CDR sequence, respectively (for the purpose of forming such a disulphide bridge, cysteine residues that naturally occur in said framework regions may be used, or alternatively cysteine residues may be synthetically added to or introduced into said framework regions). For a further description of these "Expedite fragments", reference is again made to WO 03/050531, as well as to the US provisional application of Ablynx N.V. entitled "Peptides capable of binding to serum proteins" of Ablynx N.V. (inventors: Revets, Hilde Adi Pierrette; Kolkman, Joost Alexander; and Hoogenboom, Hendricus Renerus Jacobus Mattheus) filed on Dec. 5, 2006 (see also PCT/EP2007/063348).

In another aspect, the invention relates to a compound or construct, and in particular a protein or polypeptide (also referred to herein as a "compound of the invention" or "polypeptide of the invention", respectively) that comprises or essentially consists of one or more amino acid sequences of the invention (or suitable fragments thereof), and optionally further comprises one or more other groups, residues, moieties or binding units. As will become clear to the skilled person from the further disclosure herein, such further groups, residues, moieties, binding units or amino acid sequences may or may not provide further functionality to the amino acid sequence of the invention (and/or to the compound or construct in which it is present) and may or may not modify the properties of the amino acid sequence of the invention.

For example, such further groups, residues, moieties or binding units may be one or more additional amino acid sequences, such that the compound or construct is a (fusion) protein or (fusion) polypeptide. In a preferred but non-limiting aspect, said one or more other groups, residues, moieties or binding units are immunoglobulin sequences. Even more preferably, said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES.

Alternatively, such groups, residues, moieties or binding units may for example be chemical groups, residues, moieties, which may or may not by themselves be biologically and/or pharmacologically active. For example, and without limitation, such groups may be linked to the one or more amino acid sequences of the invention so as to provide a "derivative" of an amino acid sequence or polypeptide of the invention, as further described herein.

Also within the scope of the present invention are compounds or constructs, that comprises or essentially consists of one or more derivatives as described herein, and optionally further comprises one or more other groups, residues, moieties or binding units, optionally linked via one or more linkers. Preferably, said one or more other groups, residues, moieties or binding units are amino acid sequences.

In the compounds or constructs described above, the one or more amino acid sequences of the invention and the one or more groups, residues, moieties or binding units may be linked directly to each other and/or via one or more suitable linkers or spacers. For example, when the one or more groups, residues, moieties or binding units are amino acid sequences, the linkers may also be amino acid sequences, so that the resulting compound or construct is a fusion (protein) or fusion (polypeptide).

The compounds or polypeptides of the invention can generally be prepared by a method which comprises at least one step of suitably linking the one or more amino acid sequences of the invention to the one or more further groups, residues, moieties or binding units, optionally via the one or more suitable linkers, so as to provide the compound or polypeptide of the invention. Polypeptides of the invention can also be prepared by a method which generally comprises at least the steps of providing a nucleic acid that encodes a polypeptide of the invention, expressing said nucleic acid in a suitable manner, and recovering the expressed polypeptide of the invention. Such methods can be performed in a manner known per se, which will be clear to the skilled person, for example on the basis of the methods and techniques further described herein.

The process of designing/selecting and/or preparing a compound or polypeptide of the invention, starting from an amino acid sequence of the invention, is also referred to herein as "formatting" said amino acid sequence of the invention; and an amino acid of the invention that is made part of a compound or polypeptide of the invention is said to be "formatted" or to be "in the format of" said compound or polypeptide of the invention. Examples of ways in which an amino acid sequence of the invention can be formatted and examples of such formats will be clear to the skilled person based on the disclosure herein; and such formatted amino acid sequences form a further aspect of the invention.

In one specific aspect of the invention, a compound of the invention or a polypeptide of the invention may have an increased half-life, compared to the corresponding amino acid sequence of the invention. Some preferred, but non-limiting examples of such compounds and polypeptides will become clear to the skilled person based on the further disclosure herein, and for example comprise amino acid sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one amino acid sequence of the invention that is linked to at least one moiety (and in particular at least one amino acid sequence) that increases the half-life of the amino acid sequence of the invention. Examples of polypeptides of the invention that comprise such half-life extending moieties or amino acid sequences will become clear to the skilled person based on the further disclosure herein; and for example include, without limitation, polypeptides in which the one or more amino acid sequences of the invention are suitable linked to one or more serum proteins or fragments thereof (such as (human) serum albumin or suitable fragments thereof) or to one or more binding units that can bind to serum proteins (such as, for example, domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES that can bind to serum proteins such as serum albumin (such as human serum albumin), serum immunoglobulins such as IgG, or transferrin; reference is made to the further description and references mentioned herein); polypeptides in which an amino acid sequence of the invention is linked to an Fc portion (such as a human Fc) or a suitable part or fragment thereof; or polypeptides in which the one or more amino acid sequences of the invention are suitable linked to one or more small proteins or peptides that can bind to serum proteins (such as, without limitation, the proteins and peptides described in WO 91/01743, WO 01/45746, WO 02/076489 and to the US provisional application of Ablynx N.V. entitled "Peptides capable of binding to serum proteins" of Ablynx N.V. filed on Dec. 5, 2006 (see also PCT/EP2007/063348).

Generally, the compounds or polypeptides of the invention with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the compounds or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such compounds or polypeptides of the invention have a serum half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In another preferred, but non-limiting aspect of the invention, such compounds or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another aspect, the invention relates to a nucleic acid that encodes an amino acid sequence of the invention or a polypeptide of the invention (or a suitable fragment thereof). Such a nucleic acid will also be referred to herein as a "nucleic acid of the invention" and may for example be in the form of a genetic construct, as further described herein.

In another aspect, the invention relates to a host or host cell that expresses (or that under suitable circumstances is capable of expressing) an amino acid sequence of the invention and/or a polypeptide of the invention; and/or that contains a nucleic acid of the invention. Some preferred but non-limiting examples of such hosts or host cells will become clear from the further description herein.

The invention further relates to a product or composition containing or comprising at least one amino acid sequence of the invention, at least one polypeptide of the invention (or a suitable fragment thereof) and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention also relates to the use of an amino acid sequence, NANOBODY or polypeptide of the invention, or of a composition comprising the same, in (methods or compositions for) modulating RANK-L, either in vitro (e.g. in an in vitro or cellular assay) or in vivo (e.g. in an a single cell or in a multicellular organism, and in particular in a mammal, and more in particular in a human being, such as in a human being that is at risk of or suffers from a bone disease or disorder).

The invention also relates to methods for modulating RANK-L, either in vitro (e.g. in an in vitro or cellular assay) or in vivo (e.g. in an a single cell or multicellular organism, and in particular in a mammal, and more in particular in a human being, such as in a human being that is at risk of or suffers from a bone disease or disorder), which method comprises at least the step of contacting RANK-L with at least one amino acid sequence, NANOBODY or polypeptide of the invention, or with a composition comprising the same, in a manner and in an amount suitable to modulate RANK-L, with at least one amino acid sequence, NANOBODY or polypeptide of the invention.

The invention also relates to the use of an one amino acid sequence, NANOBODY or polypeptide of the invention in the preparation of a composition (such as, without limitation, a pharmaceutical composition or preparation as further described herein) for modulating RANK-L, either in vitro (e.g. in an in vitro or cellular assay) or in vivo (e.g. in an a single cell or multicellular organism, and in particular in a mammal, and more in particular in a human being, such as in a human being that is at risk of or suffers from a bone disease or disorder).

In the context of the present invention, "modulating" or "to modulate" generally means either reducing or inhibiting the activity of, or alternatively increasing the activity of, RANK-L, as measured using a suitable in vitro, cellular or in vivo assay (such as those mentioned herein). In particular, "modulating" or "to modulate" may mean either reducing or inhibiting the activity of, or alternatively increasing the activity of RANK-L, as measured using a suitable in vitro, cellular or in vivo assay (such as those mentioned herein), by at least 1%, preferably at least 5%, such as at least 10% or at least 25%, for example by at least 50%, at least 60%, at least 70%, at least 80%, or 90% or more, compared to activity of RANK-L in the same assay under the same conditions but without the presence of the amino acid sequence, NANOBODY or polypeptide of the invention.

As will be clear to the skilled person, "modulating" may also involve effecting a change (which may either be an increase or a decrease) in affinity, avidity, specificity and/or selectivity of RANK-L for one or more of its targets, ligands or substrates; and/or effecting a change (which may either be an increase or a decrease) in the sensitivity of RANK-L for one or more conditions in the medium or surroundings in which RANK-L is present (such as pH, ion strength, the presence of co-factors, etc.), compared to the same conditions but without the presence of the amino acid sequence, NANOBODY or polypeptide of the invention. As will be clear to the skilled person, this may again be determined in any suitable manner and/or using any suitable assay known per se, such as the assays described herein or in the prior art cited herein.

"Modulating" may also mean effecting a change (i.e. an activity as an agonist or as an antagonist, respectively) with respect to one or more biological or physiological mechanisms, effects, responses, functions, pathways or activities in which RANK-L (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, such as the assays described herein or in the prior art cited herein. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the amino acid sequence, NANOBODY or polypeptide of the invention.

Modulating may for example involve reducing or inhibiting the binding of RANK-L to one of its substrates or ligands and/or competing with a natural ligand, substrate for binding to RANK-L. Modulating may also involve activating RANK-L or the mechanism or pathway in which it is involved. Modulating may be reversible or irreversible, but for pharmaceutical and pharmacological purposes will usually be in a reversible manner.

The invention further relates to methods for preparing or generating the amino acid sequences, polypeptides, nucleic acids, host cells, products and compositions described herein. Some preferred but non-limiting examples of such methods will become clear from the further description herein.

Generally, these methods may comprise the steps of:
a) providing a set, collection or library of amino acid sequences; and
b) screening said set, collection or library of amino acid sequences for amino acid sequences that can bind to and/or have affinity for RANK-L;
and
c) isolating the amino acid sequence(s) that can bind to and/or have affinity for RANK-L.

In such a method, the set, collection or library of amino acid sequences may be any suitable set, collection or library of amino acid sequences. For example, the set, collection or library of amino acid sequences may be a set, collection or library of immunoglobulin sequences (as described herein), such as a naïve set, collection or library of immunoglobulin sequences; a synthetic or semi-synthetic set, collection or library of immunoglobulin sequences; and/or a set, collection or library of immunoglobulin sequences that have been subjected to affinity maturation.

Also, in such a method, the set, collection or library of amino acid sequences may be a set, collection or library of heavy chain variable domains (such as $V_H$ domains or $V_{HH}$ domains) or of light chain variable domains. For example, the set, collection or library of amino acid sequences may be a set, collection or library of domain antibodies or single domain antibodies, or may be a set, collection or library of amino acid sequences that are capable of functioning as a domain antibody or single domain antibody.

In a preferred aspect of this method, the set, collection or library of amino acid sequences may be an immune set, collection or library of immunoglobulin sequences, for example derived from a mammal that has been suitably immunized with RANK-L or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of amino acid sequences may be displayed on a phage, phagemid, ribosome or suitable micro-organism (such as yeast), such as to facilitate screening. Suitable methods, techniques and host organisms for displaying and screening (a set, collection or library of) amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating amino acid sequences comprises at least the steps of:
a) providing a collection or sample of cells expressing amino acid sequences;
b) screening said collection or sample of cells for cells that express an amino acid sequence that can bind to and/or have affinity for RANK-L;
and
c) either (i) isolating said amino acid sequence; or (ii) isolating from said cell a nucleic acid sequence that encodes said amino acid sequence, followed by expressing said amino acid sequence.

For example, when the desired amino acid sequence is an immunoglobulin sequence, the collection or sample of cells may for example be a collection or sample of B-cells. Also, in this method, the sample of cells may be derived from a mammal that has been suitably immunized with RANK-L or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820 (2001).

In another aspect, the method for generating an amino acid sequence directed against RANK-L may comprise at least the steps of:
a) providing a set, collection or library of nucleic acid sequences encoding amino acid sequences;
b) screening said set, collection or library of nucleic acid sequences for nucleic acid sequences that encode an amino acid sequence that can bind to and/or has affinity for RANK-L;
and
c) isolating said nucleic acid sequence, followed by expressing said amino acid sequence.

In such a method, the set, collection or library of nucleic acid sequences encoding amino acid sequences may for example be a set, collection or library of nucleic acid sequences encoding a naïve set, collection or library of immunoglobulin sequences; a set, collection or library of nucleic acid sequences encoding a synthetic or semi-synthetic set, collection or library of immunoglobulin sequences; and/or a set, collection or library of nucleic acid sequences encoding a set, collection or library of immunoglobulin sequences that have been subjected to affinity maturation.

Also, in such a method, the set, collection or library of nucleic acid sequences may encode a set, collection or library of heavy chain variable domains (such as $V_H$ domains or $V_{HH}$ domains) or of light chain variable domains. For example, the set, collection or library of nucleic acid sequences may encode a set, collection or library of domain antibodies or single domain antibodies, or a set, collection or library of amino acid sequences that are capable of functioning as a domain antibody or single domain antibody.

In a preferred aspect of this method, the set, collection or library of amino acid sequences may be an immune set, collection or library of nucleic acid sequences, for example derived from a mammal that has been suitably immunized with RANK-L or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The set, collection or library of nucleic acid sequences may for example encode an immune set, collection or library of heavy chain variable domains or of light chain variable domains. In one specific aspect, the set, collection or library of nucleotide sequences may encode a set, collection or library of $V_{HH}$ sequences.

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to the review by Hoogenboom in Nature Biotechnology, 23, 9, 1105-1116 (2005).

In another aspect, the method for generating an amino acid sequence directed against RANK-L may comprise at least the steps of:
a) providing a set, collection or library of nucleic acid sequences encoding amino acid sequences;
b) screening said set, collection or library of nucleic acid sequences for nucleic acid sequences that encode an amino acid sequence that can bind to and/or has affinity for RANK-L and that is cross-blocked or is cross blocking a NANOBODY of the invention, e.g. SEQ ID NO's: 560-621, or a humanized NANOBODY of the invention, e.g. SEQ ID NO's: 730-757 and 765, or a polypeptide or construct of the invention, e.g. SEQ ID NO's: 622-729, 759-762 and 766-789; and
c) isolating said nucleic acid sequence, followed by expressing said amino acid sequence.

The invention also relates to amino acid sequences that are obtained by the above methods, or alternatively by a method that comprises the one of the above methods and in addition at least the steps of determining the nucleotide sequence or amino acid sequence of said immunoglobulin sequence; and of expressing or synthesizing said amino acid sequence in a manner known per se, such as by expression in a suitable host cell or host organism or by chemical synthesis.

Also, following the steps above, one or more amino acid sequences of the invention may be suitably humanized (or alternatively camelized); and/or the amino acid sequence(s) thus obtained may be linked to each other or to one or more other suitable amino acid sequences (optionally via one or more suitable linkers) so as to provide a polypeptide of the invention. Also, a nucleic acid sequence encoding an amino acid sequence of the invention may be suitably humanized (or alternatively camelized) and suitably expressed; and/or one or more nucleic acid sequences encoding an amino acid sequence of the invention may be linked to each other or to one or more nucleic acid sequences that encode other suitable amino acid sequences (optionally via nucleotide sequences that encode one or more suitable linkers), after which the nucleotide sequence thus obtained may be suitably expressed so as to provide a polypeptide of the invention.

The invention further relates to applications and uses of the amino acid sequences, compounds, constructs, polypeptides, nucleic acids, host cells, products and compositions described herein, as well as to methods for the prevention and/or treatment for diseases and disorders associated with RANK-L. Some preferred but non-limiting applications and uses will become clear from the further description herein.

The invention also relates to the amino acid sequences, compounds, constructs, polypeptides, nucleic acids, host cells, products and compositions described herein for use in therapy.

In particular, the invention also relates to the amino acid sequences, compounds, constructs, polypeptides, nucleic acids, host cells, products and compositions described herein for use in therapy of a disease or disorder that can be prevented or treated by administering, to a subject in need thereof, of (a pharmaceutically effective amount of) an amino acid sequence, compound, construct or polypeptide as described herein.

More in particular, the invention relates to the amino acid sequences, compounds, constructs, polypeptides, nucleic acids, host cells, products and compositions described herein for use in therapy of bone diseases and disorders.

Other aspects, embodiments, advantages and applications of the invention will also become clear from the further description herein, in which the invention will be described and discussed in more detail with reference to the NANOBODIES of the invention and polypeptides of the invention comprising the same, which form some of the preferred aspects of the invention.

As will become clear from the further description herein, NANOBODIES generally offer certain advantages (outlined herein) compared to "dAb's" or similar (single) domain antibodies or immunoglobulin sequences, which advantages are also provided by the NANOBODIES of the invention. However, it will be clear to the skilled person that the more general aspects of the teaching below can also be applied (either directly or analogously) to other amino acid sequences of the invention.

DETAILED DESCRIPTION OF THE INVENTION

In the present description, examples and claims:

a) Unless indicated or defined otherwise, all terms used have their usual meaning in the art, which will be clear to the skilled person. Reference is for example made to the standard handbooks, such as Sambrook et al, "Molecular Cloning: A Laboratory Manual" (2nd.Ed.), Vols. 1-3, Cold Spring Harbor Laboratory Press (1989); F. Ausubel et al, eds., "Current protocols in molecular biology", Green Publishing and Wiley Interscience, New York (1987); Lewin, "Genes II", John Wiley & Sons, New York, N.Y., (1985); Old et al., "Principles of Gene Manipulation: An Introduction to Genetic Engineering", 2nd edition, University of California Press, Berkeley, Calif. (1981); Roitt et al., "Immunology" (6th. Ed.), Mosby/Elsevier, Edinburgh (2001); Roitt et al., Roitt's Essential Immunology, $10^{th}$ Ed. Blackwell Publishing, UK (2001); and Janeway et al., "Immunobiology" (6th Ed.), Garland Science Publishing/Churchill Livingstone, N.Y. (2005), as well as to the general background art cited herein;

b) Unless indicated otherwise, the term "immunoglobulin sequence"—whether used herein to refer to a heavy chain antibody or to a conventional 4-chain antibody—is used as a general term to include both the full-size antibody, the individual chains thereof, as well as all parts, domains or fragments thereof (including but not limited to antigen-binding domains or fragments such as $V_{HH}$ domains or $V_H/V_L$ domains, respectively). In addition, the term "sequence" as used herein (for example in terms like "immunoglobulin sequence", "antibody sequence", "variable domain sequence", "$V_{HH}$ sequence" or "protein sequence"), should generally be understood to include both the relevant amino acid sequence as well as nucleic acid sequences or nucleotide sequences encoding the same, unless the context requires a more limited interpretation;

c) Unless indicated otherwise, all methods, steps, techniques and manipulations that are not specifically described in detail can be performed and have been performed in a manner known per se, as will be clear to the skilled person. Reference is for example again made to the standard handbooks and the general background art mentioned herein and to the further references cited therein; as well as to for example the following reviews Presta, Adv. Drug Deliv. Rev. 2006, 58 (5-6): 640-56; Levin and Weiss, Mol. Biosyst. 2006, 2(1): 49-57; Irving et al., J. Immunol. Methods, 2001, 248(1-2), 31-45; Schmitz et al., Placenta, 2000, 21 Suppl. A, S106-12, Gonzales et al., Tumour Biol., 2005, 26(1), 31-43, which describe techniques for protein engineering, such as affinity maturation and other techniques for improving the specificity and other desired properties of proteins such as immunoglobulins.

d) Amino acid residues will be indicated according to the standard three-letter or one-letter amino acid code, as mentioned in Table A-2;

TABLE A-2

| one-letter and three-letter amino acid code | | | |
|---|---|---|---|
| Nonpolar, uncharged (at pH 6.0-7.0)[3] | Alanine | Ala | A |
| | Valine | Val | V |
| | Leucine | Leu | L |
| | Isoleucine | Ile | I |
| | Phenylalanine | Phe | F |
| | Methionine[1] | Met | M |
| | Tryptophan | Trp | W |
| | Proline | Pro | P |
| Polar, uncharged (at pH 6.0-7.0) | Glycine[2] | Gly | G |
| | Serine | Ser | S |
| | Threonine | Thr | T |
| | Cysteine | Cys | C |
| | Asparagine | Asn | N |
| | Glutamine | Gln | Q |
| | Tyrosine | Tyr | Y |
| Polar, charged (at pH 6.0-7.0) | Lysine | Lys | K |
| | Arginine | Arg | R |
| | Histidine[4] | His | H |
| | Aspartate | Asp | D |
| | Glutamate | Glu | E |

Notes:
[1] Sometimes also considered to be a polar uncharged amino acid.
[2] Sometimes also considered to be a nonpolar uncharged amino acid.
[3] As will be clear to the skilled person, the fact that an amino acid residue is referred to in this Table as being either charged or uncharged at pH 6.0 to 7.0 does not reflect in any way on the charge said amino acid residue may have at a pH lower than 6.0 and/or at a pH higher than 7.0; the amino acid residues mentioned in the Table can be either charged and/or uncharged at such a higher or lower pH, as will be clear to the skilled person.
[4] As is known in the art, the charge of a His residue is greatly dependant upon even small shifts in pH, but a His residue can generally be considered essentially uncharged at a pH of about 6.5.

e) For the purposes of comparing two or more nucleotide sequences, the percentage of "sequence identity" between a first nucleotide sequence and a second nucleotide sequence may be calculated by dividing [the number of nucleotides in the first nucleotide sequence that are identical to the nucleotides at the corresponding positions in the second nucleotide sequence] by [the total number of nucleotides in the first nucleotide sequence] and multiplying by [100%], in which each deletion, insertion, substitution or addition of a nucleotide in the second nucleotide sequence—compared to the first nucleotide sequence—is considered as a difference at a single nucleotide (position).

Alternatively, the degree of sequence identity between two or more nucleotide sequences may be calculated using a known computer algorithm for sequence alignment such as NCBI Blast v2.0, using standard settings.

Some other techniques, computer algorithms and settings for determining the degree of sequence identity are for example described in WO 04/037999, EP 0 967 284, EP 1 085 089, WO 00/55318, WO 00/78972, WO 98/49185 and GB 2 357 768-A.

Usually, for the purpose of determining the percentage of "sequence identity" between two nucleotide sequences in accordance with the calculation method outlined hereinabove, the nucleotide sequence with the greatest number of nucleotides will be taken as the "first" nucleotide sequence, and the other nucleotide sequence will be taken as the "second" nucleotide sequence;

f) For the purposes of comparing two or more amino acid sequences, the percentage of "sequence identity" between a first amino acid sequence and a second amino acid sequence (also referred to herein as "amino acid identity") may be calculated by dividing [the number of amino acid residues in the first amino acid sequence that are identical to the amino acid residues at the corresponding positions in the second amino acid sequence] by [the total number of amino acid residues in the first amino acid sequence] and multiplying by [100%], in which each deletion, insertion, substitution or addition of an amino acid residue in the second amino acid sequence—compared to the first amino acid sequence—is considered as a difference at a single amino acid residue (position), i.e. as an "amino acid difference" as defined herein.

Alternatively, the degree of sequence identity between two amino acid sequences may be calculated using a known computer algorithm, such as those mentioned above for determining the degree of sequence identity for nucleotide sequences, again using standard settings.

Usually, for the purpose of determining the percentage of "sequence identity" between two amino acid sequences in accordance with the calculation method outlined hereinabove, the amino acid sequence with the greatest number of amino acid residues will be taken as the "first" amino acid sequence, and the other amino acid sequence will be taken as the "second" amino acid sequence.

Also, in determining the degree of sequence identity between two amino acid sequences, the skilled person may take into account so-called "conservative" amino acid substitutions, which can generally be described as amino acid substitutions in which an amino acid residue is replaced with another amino acid residue of similar chemical structure and which has little or essentially no influence on the function, activity or other biological properties of the polypeptide. Such conservative amino acid substitutions are well known in the art, for example from WO 04/037999, GB-A-3 357 768, WO 98/49185, WO 00/46383 and WO 01/09300; and (preferred) types and/or combinations of such substitutions may be selected on the basis of the pertinent teachings from WO 04/037999 as well as WO 98/49185 and from the further references cited therein.

Such conservative substitutions preferably are substitutions in which one amino acid within the following groups (a)-(e) is substituted by another amino acid residue within the same group: (a) small aliphatic, nonpolar or slightly polar residues: Ala, Ser, Thr, Pro and Gly; (b) polar, negatively charged residues and their (uncharged) amides: Asp, Asn, Glu and Gln; (c) polar, positively charged residues: His, Arg and Lys; (d) large aliphatic, nonpolar residues: Met, Leu, Ile, Val and Cys; and (e) aromatic residues: Phe, Tyr and Trp.

Particularly preferred conservative substitutions are as follows: Ala into Gly or into Ser; Arg into Lys; Asn into Gln or into His; Asp into Glu; Cys into Ser; Gln into Asn; Glu into Asp; Gly into Ala or into Pro; His into Asn or into Gln; Ile into Leu or into Val; Leu into Ile or into Val; Lys into Arg, into Gln or into Glu; Met into Leu, into Tyr or into Ile; Phe into Met, into Leu or into Tyr; Ser into Thr; Thr into Ser; Trp into Tyr; Tyr into Trp; and/or Phe into Val, into Ile or into Leu.

Any amino acid substitutions applied to the polypeptides described herein may also be based on the analysis of the frequencies of amino acid variations between homologous proteins of different species developed by Schulz et al., Principles of Protein Structure, Springer-Verlag, 1978, on the analyses of structure forming potentials developed by Chou and Fasman, Biochemistry 13: 211, 1974 and Adv. Enzymol., 47: 45-149, 1978, and on the analysis of hydrophobicity patterns in proteins developed by Eisenberg et al., Proc. Natl. Acad Sci. USA 81: 140-144, 1984; Kyte & Doolittle; J Molec. Biol. 157: 105-132, 198 1, and Goldman et al., Ann. Rev. Biophys. Chem. 15: 321-353, 1986, all incorporated herein in their entirety by reference. Information on the primary, secondary and tertiary structure of NANOBODIES is given in the description herein and in the general background art cited above. Also, for this purpose, the crystal structure of a $V_{HH}$ domain from a llama is for example given by Desmyter et al., Nature Structural Biology, Vol. 3, 9, 803 (1996); Spinelli et al., Natural Structural Biology (1996); 3, 752-757; and Decanniere et al., Structure, Vol. 7, 4, 361 (1999). Further information about some of the amino acid residues that in conventional $V_H$ domains form the $V_H/V_L$ interface and potential camelizing substitutions on these positions can be found in the prior art cited above.

g) Amino acid sequences and nucleic acid sequences are said to be "exactly the same" if they have 100% sequence identity (as defined herein) over their entire length;

h) When comparing two amino acid sequences, the term "amino acid difference" refers to an insertion, deletion or substitution of a single amino acid residue on a position of the first sequence, compared to the second sequence; it being understood that two amino acid sequences can contain one, two or more such amino acid differences;

i) When a nucleotide sequence or amino acid sequence is said to "comprise" another nucleotide sequence or amino acid sequence, respectively, or to "essentially consist of" another nucleotide sequence or amino acid sequence, this may mean that the latter nucleotide sequence or amino acid sequence has been incorporated into the firstmentioned nucleotide sequence or amino acid sequence, respectively, but more usually this generally means that the firstmentioned nucleotide sequence or amino acid sequence comprises within its sequence a stretch of nucleotides or amino acid residues, respectively, that has the same nucleotide sequence or amino acid sequence, respectively, as the latter sequence, irrespective of how the firstmentioned sequence has actually been generated or obtained (which may for example be by any suitable method described herein). By means of a non-limiting example, when a NANOBODY of the invention is said to comprise a CDR sequence, this may mean that said CDR sequence has been incorporated into the NANOBODY of the invention, but more usually this generally means that the NANOBODY of the invention contains within its sequence a stretch of amino acid residues with the same amino acid sequence as said CDR sequence, irrespective of how said NANOBODY of the invention has been generated or obtained. It should also be noted that when the latter amino acid sequence has a specific biological or structural function, it preferably has essentially the same, a similar or an equivalent biological or structural function in the firstmentioned amino acid sequence (in other words, the firstmentioned amino acid sequence is preferably such that the latter sequence is capable of performing essentially the same, a similar or an equivalent biological or structural function). For example, when a NANOBODY of the invention is said to comprise a CDR sequence or framework sequence, respectively, the CDR sequence and framework are preferably capable, in said NANOBODY, of functioning as a CDR sequence or framework sequence, respectively. Also, when a nucleotide sequence is said to comprise another nucleotide sequence, the firstmentioned nucleotide sequence is preferably such that, when it is expressed into an expression product (e.g. a polypeptide), the amino acid sequence encoded by the latter nucleotide sequence forms part of said expression product (in other words, that the latter nucleotide sequence is in the same reading frame as the firstmentioned, larger nucleotide sequence).

j) A nucleic acid sequence or amino acid sequence is considered to be "(in) essentially isolated (form)"—for example, compared to its native biological source and/or the reaction medium or cultivation medium from which it has been obtained—when it has been separated from at least one other component with which it is usually associated in said source or medium, such as another nucleic acid, another protein/polypeptide, another biological component or macromolecule or at least one contaminant, impurity or minor component. In particular, a nucleic acid sequence or amino acid sequence is considered "essentially isolated" when it has been purified at least 2-fold, in particular at least 10-fold, more in particular at least 100-fold, and up to 1000-fold or more. A nucleic acid sequence or amino acid sequence that is "in essentially isolated form" is preferably essentially homogeneous, as determined using a suitable technique, such as a suitable chromatographical technique, such as polyacrylamide-gel electrophoresis;

k) The term "domain" as used herein generally refers to a globular region of an amino acid sequence (such as an antibody chain, and in particular to a globular region of a heavy chain antibody), or to a polypeptide that essentially consists of such a globular region. Usually, such a domain will comprise peptide loops (for example 3 or 4 peptide loops) stabilized, for example, as a sheet or by disulfide bonds. The term "binding domain" refers to such a domain that is directed against an antigenic determinant (as defined herein);

l) The term "antigenic determinant" refers to the epitope on the antigen recognized by the antigen-binding molecule (such as a NANOBODY or a polypeptide of the invention) and more in particular by the antigen-binding site of said molecule. The terms "antigenic determinant" and "epitope" may also be used interchangeably herein.

m) An amino acid sequence (such as a NANOBODY, an antibody, a polypeptide of the invention, or generally an antigen binding protein or polypeptide or a fragment thereof) that can (specifically) bind to, that has affinity for and/or that has specificity for a specific antigenic determinant, epitope, antigen or protein (or for at least one part, fragment or epitope thereof) is said to be "against" or "directed against" said antigenic determinant, epitope, antigen or protein.

n) The term "specificity" refers to the number of different types of antigens or antigenic determinants to which a particular antigen-binding molecule or antigen-binding protein (such as a NANOBODY or a polypeptide of the invention) molecule can bind. The specificity of an antigen-binding protein can be determined based on affinity and/or avidity. The affinity, represented by the equilibrium constant for the dissociation of an antigen with an antigen-binding protein ($K_D$), is a measure for the binding strength between an antigenic determinant and an antigen-binding site on the antigen-binding protein: the lesser the value of the $K_D$, the stronger the binding strength between an antigenic determinant and the antigen-binding molecule (alternatively, the affinity can also be expressed as the affinity constant ($K_A$), which is $1/K_D$). As will be clear to the skilled person (for example on the basis of the further disclosure herein), affinity can be determined in a manner known per se, depending on the specific antigen of interest. Avidity is the measure of the strength of binding between an antigen-binding molecule (such as a NANOBODY or polypeptide of the invention) and the pertinent antigen. Avidity is related to both the affinity between an antigenic determinant and its antigen binding site on the antigen-binding molecule and the number of pertinent binding sites present on the antigen-binding molecule. Typically, antigen-binding proteins (such as the amino acid sequences, NANOBODIES and/or polypeptides of the invention) will bind to their antigen with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles). Any $K_D$ value greater than $10^4$ mol/liter (or any $K_A$ value lower than $10^4$ $M^{-1}$) liters/mol is generally considered to indicate non-specific binding. Preferably, a monovalent immunoglobulin sequence of the invention will bind to the desired antigen with an affinity less than 500 nM, preferably less than 200 nM, more preferably less than 10 nM, such as less than 500 pM. Specific binding of an antigen-binding protein to an antigen or antigenic determinant can be determined in any suitable manner known per se, including, for example, Scatchard analysis and/or competitive binding assays, such as radioimmunoassays (RIA), enzyme immunoassays (EIA) and sandwich competition assays, and the different variants thereof known per se in the art; as well as the other techniques mentioned herein.

The dissociation constant may be the actual or apparent dissociation constant, as will be clear to the skilled person. Methods for determining the dissociation constant will be clear to the skilled person, and for example include the techniques mentioned herein. In this respect, it will also be clear that it may not be possible to measure dissociation constants of more then $10^{-4}$ moles/liter or $10^{-3}$ moles/liter (e.g., of $10^{-2}$ moles/liter). Optionally, as will also be clear to the skilled person, the (actual or apparent) dissociation constant may be calculated on the basis of the (actual or apparent) association constant ($K_A$), by means of the relationship [$K_D = 1/K_A$].

The affinity denotes the strength or stability of a molecular interaction. The affinity is commonly given as by the $K_D$, or dissociation constant, which has units of mol/liter (or M). The affinity can also be expressed as an association constant, $K_A$, which equals $1/K_D$ and has units of $(mol/liter)^{-1}$ (or $M^{-1}$). In the present specification, the stability of the interaction between two molecules (such as an amino acid sequence, NANOBODY or polypeptide of the invention and its intended target) will mainly be expressed in terms of the $K_D$ value of their interaction; it being clear to the skilled person that in view of the relation $K_A = 1/K_D$, specifying the strength of molecular interaction by its $K_D$ value can also be used to calculate the corresponding $K_A$ value. The $K_D$-value characterizes the strength of a molecular interaction also in a thermodynamic sense as it is related to the free energy (DG) of binding by the well known relation $DG=RT \cdot \ln(K_D)$ (equivalently $DG=-RT \cdot \ln(K_A)$), where R equals the gas constant, T equals the absolute temperature and ln denotes the natural logarithm.

The $K_D$ for biological interactions which are considered meaningful (e.g. specific) are typically in the range of $10^{-10}$ M (0.1 nM) to $10^{-5}$ M (10000 nM). The stronger an interaction is, the lower is its $K_D$.

The $K_D$ can also be expressed as the ratio of the dissociation rate constant of a complex, denoted as $k_{off}$, to the rate of its association, denoted $k_{on}$ (so that $K_D=k_{off}/k_{on}$ and $K_A=k_{on}/k_{off}$). The off-rate $k_{off}$ has units $s^{-1}$ (where s is the SI unit notation of second). The on-rate $k_{on}$ has units $M^{-1}\,s^{-1}$. The on-rate may vary between $10^2$ $M^{-1}s^{-1}$ to about $10^7$ $M^{-1}s^{-1}$, approaching the diffusion-limited association rate constant for bimolecular interactions. The off-rate is related to the half-life of a given molecular interaction by the relation $t_{1/2}=\ln(2)/k_{off}$. The off-rate may vary between $10^{-6}$ $s^{-1}$ (near irreversible complex with a $t_{1/2}$ of multiple days) to 1 $s^{-1}$ ($t_{1/2}=0.69$ s).

The affinity of a molecular interaction between two molecules can be measured via different techniques known per se, such as the well known surface plasmon resonance (SPR) biosensor technique (see for example Ober et al., Intern. Immunology, 13, 1551-1559, 2001) where one molecule is immobilized on the biosensor chip and the other molecule is passed over the immobilized molecule under flow conditions yielding $k_{on}$, $k_{off}$ measurements and hence $K_D$ (or $K_A$) values. This can for example be performed using the well-known BIACORE instruments.

It will also be clear to the skilled person that the measured $K_D$ may correspond to the apparent $K_D$ if the measuring process somehow influences the intrinsic binding affinity of the implied molecules for example by artefacts related to the coating on the biosensor of one molecule. Also, an apparent $K_D$ may be measured if one molecule contains more than one recognition sites for the other molecule. In such situation the measured affinity may be affected by the avidity of the interaction by the two molecules.

Another approach that may be used to assess affinity is the 2-step ELISA (Enzyme-Linked Immunosorbent Assay) procedure of Friguet et al. (J. Immunol. Methods, 77, 305-19, 1985). This method establishes a solution phase binding equilibrium measurement and avoids possible artefacts relating to adsorption of one of the molecules on a support such as plastic.

However, the accurate measurement of $K_D$ may be quite labor-intensive and as consequence, often apparent $K_D$ values are determined to assess the binding strength of two molecules. It should be noted that as long all measurements are made in a consistent way (e.g. keeping the assay conditions unchanged) apparent $K_D$ measurements can be used as an approximation of the true $K_D$ and hence in the present document $K_D$ and apparent $K_D$ should be treated with equal importance or relevance. Finally, it should be noted that in many situations the experienced scientist may judge it to be convenient to determine the binding affinity relative to some reference molecule. For example, to assess the binding strength between molecules A and B, one may e.g. use a reference molecule C that is known to bind to B and that is suitably labelled with a fluorophore or chromophore group or other chemical moiety, such as biotin for easy detection in an ELISA or FACS (Fluorescent activated cell sorting) or other format (the fluorophore for fluorescence detection, the chromophore for light absorption detection, the biotin for streptavidin-mediated ELISA detection). Typically, the reference molecule C is kept at a fixed concentration and the concentration of A is varied for a given concentration or amount of B. As a result an $IC_{50}$ value is obtained corresponding to the concentration of A at which the signal measured for C in absence of A is halved. Provided $K_{D\,ref}$, the $K_D$ of the reference molecule, is known, as well as the total concentration $c_{ref}$ of the reference molecule, the apparent $K_D$ for the interaction A-B can be obtained from following formula: $K_D=IC_{50}/(1+c_{ref}/K_{D\,ref})$. Note that if $c_{ref}<<K_{D\,ref}$, $K_D \approx IC_{50}$. Provided the measurement of the $IC_{50}$ is performed in a consistent way (e.g. keeping $c_{ref}$ fixed) for the binders that are compared, the strength or stability of a molecular interaction can be assessed by the $IC_{50}$ and this measurement is judged as equivalent to $K_D$ or to apparent $K_D$ throughout this text.

o) The half-life of an amino acid sequence, compound or polypeptide of the invention can generally be defined as the time taken for the serum concentration of the amino acid sequence, compound or polypeptide to be reduced by 50%, in vivo, for example due to degradation of the sequence or compound and/or clearance or sequestration of the sequence or compound by natural mechanisms. The in vivo half-life of an amino acid sequence, compound or polypeptide of the invention can be determined in any manner known per se, such as by pharmacokinetic analysis. Suitable techniques will be clear to the person skilled in the art, and may for example generally involve the steps of suitably administering to a warm-blooded animal (i.e. to a human or to another suitable mammal, such as a mouse, rabbit, rat, pig, dog or a primate, for example monkeys from the genus *Macaca* (such as, and in particular, cynomolgus monkeys (*Macaca fascicularis*) and/or rhesus monkeys (*Macaca mulatta*)) and baboon (*Papio ursinus*)) a suitable dose of the amino acid sequence, compound or polypeptide of the invention; collecting blood samples or other samples from said animal; determining the level or concentration of the amino acid sequence, compound or polypeptide of the invention in said blood sample; and calculating, from (a plot of) the data thus obtained, the time until the level or concentration of the amino acid sequence, compound or polypeptide of the invention has been reduced by 50% compared to the initial level upon dosing. Reference is for example made to the Experimental Part below, as well as to the standard handbooks, such as Kenneth, A et al: Chemical Stability of Pharmaceuticals: A Handbook for Pharmacists and Peters et al, Pharmacokinete analysis: A Practical Approach (1996). Reference is also made to "Pharmacokinetics", M Gibaldi & D Perron, published by Marcel Dekker, 2nd Rev. edition (1982).

As will also be clear to the skilled person (see for example pages 6 and 7 of WO 04/003019 and in the further references cited therein), the half-life can be expressed using parameters such as the t½-alpha, t½-beta and the area under the curve (AUC). In the present specification, an "increase in half-life" refers to an increase in any one of these parameters, such as any two of these parameters, or essentially all three these parameters. As used herein "increase in half-life" or "increased half-life" in particular refers to an increase in the t½-beta, either with or without an increase in the t½-alpha and/or the AUC or both.

p) In the context of the present invention, "modulating" or "to modulate" generally means either reducing or inhibiting the activity of, or alternatively increasing the activity of, a target or antigen, as measured using a suitable in vitro, cellular or in vivo assay. In particular, "modulating" or "to modulate" may mean either reducing or inhibiting the activity of, or alternatively increasing a (relevant or intended) biological activity of, a target or antigen, as measured using a suitable in vitro, cellular or in vivo assay (which will usually depend on the target or antigen involved), by at least 1%, preferably at least 5%, such as at least 10% or at least 25%, for example by at least 50%, at least 60%, at least 70%, at least 80%, or 90% or more, compared to activity of the target or antigen in the same assay under the same conditions but without the presence of the construct of the invention.

As will be clear to the skilled person, "modulating" may also involve effecting a change (which may either be an increase or a decrease) in affinity, avidity, specificity and/or selectivity of a target or antigen for one or more of its ligands, binding partners, partners for association into a homomultimeric or heteromultimeric form, or substrates; and/or effecting a change (which may either be an increase or a decrease) in the sensitivity of the target or antigen for one or more conditions in the medium or surroundings in which the target or antigen is present (such as pH, ion strength, the presence of co-factors, etc.), compared to the same conditions but without the presence of the construct of the invention. As will be clear to the skilled person, this may again be determined in any suitable manner and/or using any suitable assay known per se, depending on the target or antigen involved.

"Modulating" may also mean effecting a change (i.e. an activity as an agonist, as an antagonist or as a reverse agonist, respectively, depending on the target or antigen and the desired biological or physiological effect) with respect to one or more biological or physiological mechanisms, effects, responses, functions, pathways or activities in which the target or antigen (or in which its substrate(s), ligand(s) or pathway(s) are involved, such as its signalling pathway or metabolic pathway and their associated biological or physiological effects) is involved. Again, as will be clear to the skilled person, such an action as an agonist or an antagonist may be determined in any suitable manner and/or using any suitable (in vitro and usually cellular or in assay) assay known per se, depending on the target or antigen involved. In particular, an action as an agonist or antagonist may be such that an intended biological or physiological activity is increased or decreased, respectively, by at least 1%, preferably at least 5%, such as at least 10% or at least 25%, for example by at least 50%, at least 60%, at least 70%, at least 80%, or 90% or more, compared to the biological or physiological activity in the same assay under the same conditions but without the presence of the construct of the invention.

Modulating may for example also involve allosteric modulation of the target or antigen; and/or reducing or inhibiting the binding of the target or antigen to one of its substrates or ligands and/or competing with a natural ligand, substrate for binding to the target or antigen. Modulating may also involve activating the target or antigen or the mechanism or pathway in which it is involved. Modulating may for example also involve effecting a change in respect of the folding or confirmation of the target or antigen, or in respect of the ability of the target or antigen to fold, to change its confirmation (for example, upon binding of a ligand), to associate with other (sub)units, or to disassociate.

Modulating may for example also involve effecting a change in the ability of the target or antigen to transport other compounds or to serve as a channel for other compounds (such as ions).

Modulating may be reversible or irreversible, but for pharmaceutical and pharmacological purposes will usually be in a reversible manner.

q) In respect of a target or antigen, the term "interaction site" on the target or antigen means a site, epitope, antigenic determinant, part, domain or stretch of amino acid residues on the target or antigen that is a site for binding to a ligand, receptor or other binding partner, a catalytic site, a cleavage site, a site for allosteric interaction, a site involved in multimerisation (such as homomerization or heterodimerization) of the target or antigen; or any other site, epitope, antigenic determinant, part, domain or stretch of amino acid residues on the target or antigen that is involved in a biological action or mechanism of the target or antigen. More generally, an "interaction site" can be any site, epitope, antigenic determinant, part, domain or stretch of amino acid residues on the target or antigen to which an amino acid sequence or polypeptide of the invention can bind such that the target or antigen (and/or any pathway, interaction, signalling, biological mechanism or biological effect in which the target or antigen is involved) is modulated (as defined herein).

r) An amino acid sequence or polypeptide is said to be "specific for" a first target or antigen compared to a second target or antigen when is binds to the first antigen with an affinity (as described above, and suitably expressed as a $K_D$ value, $K_A$ value, $K_{off}$ rate and/or $K_{on}$ rate) that is at least 10 times, such as at least 100 times, and preferably at least 1000 times, and up to 10.000 times or more better than the affinity with which said amino acid sequence or polypeptide binds to the second target or polypeptide. For example, the first antigen may bind to the target or antigen with a $K_D$ value that is at least 10 times less, such as at least 100 times less, and preferably at least 1000 times less, such as 10.000 times less or even less than that, than the $K_D$ with which said amino acid sequence or polypeptide binds to the second target or polypeptide. Preferably, when an amino acid sequence or polypeptide is "specific for" a first target or antigen compared to a second target or antigen, it is directed against (as defined herein) said first target or antigen, but not directed against said second target or antigen.

s) The terms "cross-block", "cross-blocked" and "cross-blocking" are used interchangeably herein to mean the ability of an amino acid sequence or other binding agents (such as a polypeptide of the invention) to interfere with the binding of other amino acid sequences or binding agents of the invention to a given target. The extend to which an amino acid sequence or other binding agent of the invention is able to interfere with the binding of another to RANK-L, and therefore whether it can be said to cross-block according to the invention, can be determined using competition binding assays. One particularly suitable quantitative cross-blocking assay uses a BIA-CORE machine which can measure the extent of interactions using surface plasmon resonance technology.

Another suitable quantitative cross-blocking assay uses an ELISA-based approach to measure competition between amino acid sequences or other binding agents in terms of their binding to the target.

The following generally describes a suitable BIACORE assay for determining whether an amino acid sequence or other binding agent cross-blocks or is capable of cross-blocking according to the invention. It will be appreciated that the assay can be used with any of the amino acid sequence or other binding agents described herein. The BIACORE machine (for example the BIACORE 3000) is operated in line with the manufacturer's recommendations. Thus in one cross-blocking assay, the target protein is coupled to a CM5 BIACORE chip using standard amine coupling chemistry to generate a surface that is coated with the target. Typically 200-800 resonance units of the target would be coupled to the chip (an amount that gives easily measurable levels of binding but that is readily saturable by the concentrations of test reagent being used). Two test amino acid sequences (termed A* and B*) to be assessed for their ability to cross-block each other are mixed at a one to one molar ratio of binding sites in a suitable buffer to create the test mixture. When calculating the concentrations on a binding site basis the molecular weight of an amino acid sequence is assumed to be the total molecular weight of the amino acid sequence divided by the number of target binding sites on that amino acid sequence. The concentration of each amino acid sequence in the test mix should be high enough to readily saturate the binding sites for that amino acid sequence on the target molecules captured on the BIACORE chip. The amino acid sequences in the mixture are at the same molar concentration (on a binding basis) and that concentration would typically be between 1.00 and 1.5 micromolar (on a binding site basis). Separate solutions containing A* alone and B* alone are also prepared. A* and B* in these solutions should be in the same buffer and at the same concentration as in the test mix. The test mixture is passed over the target-coated BIACORE chip and the total amount of binding recorded. The chip is then treated in such a way as to remove the bound amino acid sequences without damaging the chip-bound target. Typically this is done by treating the chip with 30 mM HCl for 60 seconds. The solution of A* alone is then passed over the target-coated surface and the amount of binding recorded. The chip is again treated to remove all of the bound amino acid sequences without damaging the chip-bound target. The solution of B* alone is then passed over the target-coated surface and the amount of binding recorded. The maximum theoretical binding of the mixture of A* and B* is next calculated, and is the sum of the binding of each amino acid sequence when passed over the target surface alone. If the actual recorded binding of the mixture is less than this theoretical maximum then the two amino acid sequences are cross-blocking each other. Thus, in general, a cross-blocking amino acid sequence or other binding agent according to the invention is one which will bind to the target in the above BIACORE cross-blocking assay such that during the assay and in the presence of a second amino acid sequence or other binding agent of the invention the recorded binding is between 80% and 0.1% (e.g. 80% to 4%) of the maximum theoretical binding, specifically between 75% and 0.1% (e.g. 75% to 4%) of the maximum theoretical binding, and more specifically between 70% and 0.1% (e.g. 70% to 4%) of maximum theoretical binding (as just defined above) of the two amino acid sequences or binding agents in combination. The BIACORE assay described above is a primary assay used to determine if amino acid sequences or other binding agents cross-block each other according to the invention. On rare occasions particular amino acid sequences or other binding agents may not bind to target coupled via amine chemistry to a CM5 BIACORE chip (this usually occurs when the relevant binding site on target is masked or destroyed by the coupling to the chip). In such cases cross-blocking can be determined using a tagged version of the target, for example a N-terminal His-tagged version. In this particular format, an anti-His amino acid sequence would be coupled to the BIACORE chip and then the His-tagged target would be passed over the surface of the chip and captured by the anti-His amino acid sequence. The cross blocking analysis would be carried out essentially as described above, except that after each chip regeneration cycle, new His-tagged target would be loaded back onto the anti-His amino acid sequence coated surface. In addition to the example given using N-terminal His-tagged target, C-terminal His-tagged target could alternatively be used. Furthermore, various other tags and tag binding protein combinations that are known in the art could be used for such a cross-blocking analysis (e.g. HA tag with anti-HA antibodies; FLAG tag with anti-FLAG antibodies; biotin tag with streptavidin).

The following generally describes an ELISA assay for determining whether an amino acid sequence or other binding agent directed against a target cross-blocks or is capable of cross-blocking as defined herein. It will be appreciated that the assay can be used with any of the amino acid sequences (or other binding agents such as polypeptides of the invention) described herein. The general principal of the assay is to have an amino acid sequence or binding agent that is directed against the target coated onto the wells of an ELISA plate. An excess amount of a second, potentially cross-blocking, anti-target amino acid sequence is added in solution (i.e. not bound to the ELISA plate). A limited amount of the target is then added to the wells. The coated amino acid sequence and the amino acid sequence in solution compete for binding of the limited number of target molecules. The plate is washed to remove excess target that has not been bound by the coated amino acid sequence and to also remove the second, solution phase amino acid sequence as well as any complexes formed between the second, solution phase amino acid sequence and target. The amount of bound target is then measured using a reagent that is appropriate to detect the target. An amino acid sequence in solution that is able to cross-block the coated amino acid sequence will be able to cause a decrease in the number of target molecules that the coated amino acid sequence can bind relative to the number of target molecules that the coated amino acid sequence can bind in the absence of the second, solution phase, amino acid sequence. In the instance where the first amino acid sequence, e.g. an Ab-X, is chosen to be the immobilized amino acid sequence, it is coated onto the wells of the ELISA plate, after which the plates are blocked with a suitable blocking solution to minimize non-specific binding of reagents that are subsequently added. An excess amount of the second amino acid sequence, i.e. Ab-Y, is then added to the ELISA plate such that the moles of Ab-Y target binding sites per well are at least 10 fold higher than the moles of Ab-X target binding sites that were used, per well, during the coating of the ELISA plate. Target is then added such that the moles of target added per well are at least 25-fold lower than the moles of Ab-X target binding sites that were used for coating each well. Following a suitable incubation period the ELISA plate is washed and a reagent for detecting the target is added to measure the amount of target specifically bound by the coated anti-target amino acid sequence (in this case Ab-X). The background signal for the assay is defined as the signal obtained in wells with the coated amino acid sequence (in this case Ab-X), second solution phase amino acid sequence (in this case Ab-Y), target buffer only (i.e. without target added) and target detection reagents. The positive control signal for the assay is defined as the signal obtained in wells with the coated amino acid sequence (in this case Ab-X), second solution phase amino acid sequence buffer only (i.e. without second solution phase amino acid sequence added), target and target detection reagents. The ELISA assay may be run in such a manner so as to have the positive control signal be at least 6 times the background signal. To avoid any artefacts (e.g. significantly different affinities between Ab-X and Ab-Y for the target) resulting from the choice of which amino acid sequence to use as the coating amino acid sequence and which to use as the second (competitor) amino acid sequence, the cross-blocking assay may to be run in two formats: 1) format 1 is where Ab-X is the amino acid sequence that is coated onto the ELISA plate and Ab-Y is the competitor amino acid sequence that is in solution and 2) format 2 is where Ab-Y is the amino acid sequence that is coated onto the ELISA plate and Ab-X is the competitor amino acid sequence that is in solution. Ab-X and Ab-Y are defined as cross-blocking if, either in format 1 or in format 2, the solution phase anti-target amino acid sequence is able to cause a reduction of between 60% and 100%, specifically between 70% and 100%, and more specifically between 80% and 100%, of the target detection signal {i.e. the amount of target bound by the coated amino acid sequence) as compared to the target detection signal obtained in the absence of the solution phase anti-target amino acid sequence (i.e. the positive control wells).

t) An amino acid sequence is said to be "cross-reactive" for two different antigens or antigenic determinants if it is specific for (as defined herein) both these different antigens or antigenic determinants.

u) By binding that is "essentially independent of the pH" is generally meant herein that the association constant ($K_A$) of the amino acid sequence with respect to the serum protein (such as serum albumin) at the pH value(s) that occur in a cell of an animal or human body (as further described herein) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the association constant ($K_A$) of the amino acid sequence with respect to the same serum protein at the pH value(s) that occur outside said cell. Alternatively, by binding that is "essentially independent of the pH" is generally meant herein that the $k_{off}$ rate (measured by BIACORE) of the amino acid sequence with respect to the serum protein (such as serum albumin) at the pH value(s) that occur in a cell of an animal or human body (as e.g. further described herein, e.g. pH around 5.5, e.g. 5.3 to 5.7) is at least 5%, such as at least 10%, preferably at least 25%, more preferably at least 50%, even more preferably at least 60%, such as even more preferably at least 70%, such as at least 80% or 90% or more (or even more than 100%, such as more than 110%, more than 120% or even 130% or more, or even more than 150%, or even more than 200%) of the $k_{off}$ rate of the amino acid sequence with respect to the same serum protein at the pH value(s) that occur outside said cell, e.g. pH 7.2 to 7.4. By "the pH value(s) that occur in a cell of an animal or human body" is meant the pH value(s) that may occur inside a cell, and in particular inside a cell that is involved in the recycling of the serum protein. In particular, by "the pH value(s) that occur in a cell of an animal or human body" is meant the pH value(s) that may occur inside a (sub)cellular compartment or vesicle that is involved in recycling of the serum protein (e.g. as a result of pinocytosis, endocytosis, transcytosis, exocytosis and phagocytosis or a similar mechanism of uptake or internalization into said cell), such as an endosome, lysosome or pinosome.

v) As further described herein, the total number of amino acid residues in a NANOBODY can be in the region of 110-120, is preferably 112-115, and is most preferably 113. It should however be noted that parts, fragments, analogs or derivatives (as further described herein) of a NANOBODY are not particularly limited as to their length and/or size, as long as such parts, fragments, analogs or derivatives meet the further requirements outlined herein and are also preferably suitable for the purposes described herein;

w) The amino acid residues of a NANOBODY are numbered according to the general numbering for $V_H$ domains given by Kabat et al. ("Sequence of proteins of immunological interest", US Public Health Services, NIH Bethesda, Md., Publication No. 91), as applied to $V_{HH}$ domains from Camelids in the article of Riechmann and Muyldermans, J. Immunol. Methods 2000 Jun. 23; 240 (1-2): 185-195 (see for example FIG. 2 of this publication); or referred to herein. According to this numbering, FR1 of a NANOBODY comprises the amino acid residues at positions 1-30, CDR1 of a NANOBODY comprises the amino acid residues at positions 31-35, FR2 of a NANOBODY comprises the amino acids at positions 36-49, CDR2 of a NANOBODY comprises the amino acid residues at positions 50-65, FR3 of a NANOBODY comprises the amino acid residues at positions 66-94, CDR3 of a NANOBODY comprises the amino acid residues at positions 95-102, and FR4 of a NANOBODY comprises the amino acid residues at positions 103-113. [In this respect, it should be noted that—as is well known in the art for $V_H$ domains and for $V_{HH}$ domains—the total number of amino acid residues in each of the CDR's may vary and may not correspond to the total number of amino acid residues indicated by the Kabat numbering (that is, one or more positions according to the Kabat numbering may not be occupied in the actual sequence, or the actual sequence may contain more amino acid residues than the number allowed for by the Kabat numbering). This means that, generally, the numbering according to Kabat may or may not correspond to the actual numbering of the amino acid residues in the actual sequence. Generally, however, it can be said that, according to the numbering of Kabat and irrespective of the number of amino acid residues in the CDR's, position 1 according to the Kabat numbering corresponds to the start of FR1 and vice versa, position 36 according to the Kabat numbering corresponds to the start of FR2 and vice versa, position 66 according to the Kabat numbering corresponds to the start of FR3 and vice versa, and position 103 according to the Kabat numbering corresponds to the start of FR4 and vice versa.].

Alternative methods for numbering the amino acid residues of $V_H$ domains, which methods can also be applied in an analogous manner to $V_{HH}$ domains from Camelids and to NANOBODIES, are the method described by Chothia et al. (Nature 342, 877-883 (1989)), the so-called "AbM definition" and the so-called "contact definition". However, in the present description, claims and figures, the numbering according to Kabat as applied to $V_{HH}$ domains by Riechmann and Muyldermans will be followed, unless indicated otherwise; and x) The Figures, Sequence Listing and the Experimental Part/Examples are only given to further illustrate the invention and should not be interpreted or construed as limiting the scope of the invention and/or of the appended claims in any way, unless explicitly indicated otherwise herein.

For a general description of heavy chain antibodies and the variable domains thereof, reference is inter alia made to the prior art cited herein, to the review article by Muyldermans in Reviews in Molecular Biotechnology 74(2001), 277-302; as well as to the following patent applications, which are mentioned as general background art: WO 94/04678, WO 95/04079 and WO 96/34103 of the Vrije Universiteit Brussel; WO 94/25591, WO 99/37681, WO 00/40968, WO 00/43507, WO 00/65057, WO 01/40310, WO 01/44301, EP 1134231 and WO 02/48193 of Unilever; WO 97/49805, WO 01/21817, WO 03/035694, WO 03/054016 and WO 03/055527 of the Vlaams Instituut voor Biotechnologie (VIB); WO 03/050531 of Algonomics N.V. and Ablynx N.V.; WO 01/90190 by the National Research Council of Canada; WO 03/025020 (=EP 1 433 793) by the Institute of Antibodies; as well as WO 04/041867, WO 04/041862, WO 04/041865, WO 04/041863, WO 04/062551, WO 05/044858, WO 06/40153, WO 06/079372, WO 06/122786, WO 06/122787 and WO 06/122825, by Ablynx N.V. and the further published patent applications by Ablynx N.V. Reference is also made to the further prior art mentioned in these applications, and in particular to the list of references mentioned on pages 41-43 of the International application WO 06/040153, which list and references are incorporated herein by reference.

In accordance with the terminology used in the art (see the above references), the variable domains present in naturally occurring heavy chain antibodies will also be referred to as "$V_{HH}$ domains", in order to distinguish them from the heavy chain variable domains that are present in conventional 4-chain antibodies (which will be referred to hereinbelow as "$V_H$ domains") and from the light chain variable domains that are present in conventional 4-chain antibodies (which will be referred to hereinbelow as "$V_L$ domains").

As mentioned in the prior art referred to above, $V_{HH}$ domains have a number of unique structural characteristics and functional properties which make isolated $V_{HH}$ domains (as well as NANOBODIES based thereon, which share these structural characteristics and functional properties with the naturally occurring $V_{HH}$ domains) and proteins containing the same highly advantageous for use as functional antigen-binding domains or proteins. In particular, and without being limited thereto, $V_{HH}$ domains (which have been "designed" by nature to functionally bind to an antigen without the presence of, and without any interaction with, a light chain variable domain) and NANOBODIES can function as a single, relatively small, functional antigen-binding structural unit, domain or protein. This distinguishes the $V_{HH}$ domains from the $V_H$ and $V_L$ domains of conventional 4-chain antibodies, which by themselves are generally not suited for practical application as single antigen-binding proteins or domains, but need to be combined in some form or another to provide a functional antigen-binding unit (as in for example conventional antibody fragments such as Fab fragments; in ScFv's fragments, which consist of a $V_H$ domain covalently linked to a $V_L$ domain).

Because of these unique properties, the use of $V_{HH}$ domains and NANOBODIES as single antigen-binding proteins or as antigen-binding domains (i.e. as part of a larger protein or polypeptide) offers a number of significant advantages over the use of conventional $V_H$ and $V_L$ domains, scFv's or conventional antibody fragments (such as Fab- or F(ab')$_2$-fragments):

only a single domain is required to bind an antigen with high affinity and with high selectivity, so that there is no need to have two separate domains present, nor to assure that these two domains are present in the right spatial conformation and configuration (i.e. through the use of especially designed linkers, as with scFv's);

$V_{HH}$ domains and NANOBODIES can be expressed from a single gene and require no post-translational folding or modifications;

$V_{HH}$ domains and NANOBODIES can easily be engineered into multivalent and multispecific formats (as further discussed herein);

$V_{HH}$ domains and NANOBODIES are highly soluble and do not have a tendency to aggregate (as with the mouse-derived "dAb's" described by Ward et al., Nature, Vol. 341, 1989, p. 544);

$V_{HH}$ domains and NANOBODIES are highly stable to heat, pH, proteases and other denaturing agents or conditions (see for example Ewert et al, supra);

$V_{HH}$ domains and NANOBODIES are easy and relatively cheap to prepare, even on a scale required for production. For example, $V_{HH}$ domains, NANOBODIES and proteins/polypeptides containing the same can be produced using microbial fermentation (e.g. as further described below) and do not require the use of mammalian expression systems, as with for example conventional antibody fragments;

$V_{HH}$ domains and NANOBODIES are relatively small (approximately 15 kDa, or 10 times smaller than a conventional IgG) compared to conventional 4-chain antibodies and antigen-binding fragments thereof, and therefore show high(er) penetration into tissues (including but not limited to solid tumors and other dense tissues) than such conventional 4-chain antibodies and antigen-binding fragments thereof;

$V_{HH}$ domains and NANOBODIES can show so-called cavity-binding properties (inter alia due to their extended CDR3 loop, compared to conventional $V_H$ domains) and can therefore also access targets and epitopes not accessible to conventional 4-chain antibodies and antigen-binding fragments thereof. For example, it has been shown that $V_{HH}$ domains and NANOBODIES can inhibit enzymes (see for example WO 97/49805; Transue et al., Proteins 1998 Sep. 1; 32(4): 515-22; Lauwereys et al., EMBO J. 1998 Jul. 1; 17(13): 3512-20).

In a specific and preferred aspect, the invention provides NANOBODIES against RANK-L, and in particular NANOBODIES against RANK-L from a warm-blooded animal, and more in particular NANOBODIES against RANK-L from a mammal, and especially NANOBODIES against human RANK-L; as well as proteins and/or polypeptides comprising at least one such NANOBODY.

In particular, the invention provides NANOBODIES against RANK-L, and proteins and/or polypeptides comprising the same, that have improved therapeutic and/or pharmacological properties and/or other advantageous properties (such as, for example, improved ease of preparation and/or reduced costs of goods), compared to conventional antibodies against RANK-L or fragments thereof, compared to constructs that could be based on such conventional antibodies or antibody fragments (such as Fab' fragments, F(ab')$_2$ fragments, ScFv constructs, "diabodies" and other multispecific constructs (see for example the review by Holliger and Hudson, Nat Biotechnol. 2005 September; 23(9):1126-36)), and also compared to the so-called "dAb's" or similar (single) domain antibodies that may be derived from variable domains of conventional antibodies. These improved and advantageous properties will become clear from the further description herein, and for example include, without limitation, one or more of:

increased affinity and/or avidity for RANK-L, either in a monovalent format, in a multivalent format (for example in a bivalent format) and/or in a multispecific format (for example one of the multispecific formats described hereinbelow);

better suitability for formatting in a multivalent format (for example in a bivalent format);

better suitability for formatting in a multispecific format (for example one of the multispecific formats described hereinbelow);

improved suitability or susceptibility for "humanizing" substitutions (as defined herein);

less immunogenicity, either in a monovalent format, in a multivalent format (for example in a bivalent format) and/or in a multispecific format (for example one of the multispecific formats described hereinbelow);

increased stability, either in a monovalent format, in a multivalent format (for example in a bivalent format) and/or in a multispecific format (for example one of the multispecific formats described hereinbelow);

increased specificity towards RANK-L, either in a monovalent format, in a multivalent format (for example in a bivalent format) and/or in a multispecific format (for example one of the multispecific formats described hereinbelow);

decreased or where desired increased cross-reactivity with RANK-L from different species;

and/or one or more other improved properties desirable for pharmaceutical use (including prophylactic use and/or therapeutic use) and/or for diagnostic use (including but not limited to use for imaging purposes), either in a monovalent format, in a multivalent format (for example in a bivalent format) and/or in a multispecific format (for example one of the multispecific formats described hereinbelow).

As generally described herein for the amino acid sequences of the invention, the NANOBODIES of the invention are preferably in essentially isolated form (as defined herein), or form part of a protein or polypeptide of the invention (as defined herein), which may comprise or essentially consist of one or more NANOBODIES of the invention and which may optionally further comprise one or more further amino acid sequences (all optionally linked via one or more suitable linkers). For example, and without limitation, the one or more amino acid sequences of the invention may be used as a binding unit in such a protein or polypeptide, which may optionally contain one or more further amino acid sequences that can serve as a binding unit (i.e. against one or more other targets than RANK-L), so as to provide a monovalent, multivalent or multispecific polypeptide of the invention, respectively, all as described herein. In particular, such a protein or polypeptide may comprise or essentially consist of one or more NANOBODIES of the invention and optionally one or more (other) NANOBODIES (i.e. directed against other targets than RANK-L), all optionally linked via one or more suitable linkers, so as to provide a monovalent, multivalent or multispecific NANOBODY construct, respectively, as further described herein. Such proteins or polypeptides may also be in essentially isolated form (as defined herein).

In a NANOBODY of the invention, the binding site for binding against RANK-L is preferably formed by the CDR sequences. Optionally, a NANOBODY of the invention may also, and in addition to the at least one binding site for binding against RANK-L, contain one or more further binding sites for binding against other antigens, proteins or targets. For methods and positions for introducing such second binding sites, reference is for example made to Keck and Huston, Biophysical Journal, 71, October 1996, 2002-2011; EP 0 640 130 and WO 06/07260.

As generally described herein for the amino acid sequences of the invention, when a NANOBODY of the invention (or a polypeptide of the invention comprising the same) is intended for administration to a subject (for example for therapeutic and/or diagnostic purposes as described herein), it is preferably directed against human RANK-L; whereas for veterinary purposes, it is preferably directed against RANK-L from the species to be treated. Also, as with the amino acid sequences of the invention, a NANOBODY of the invention may or may not be cross-reactive (i.e. directed against RANK-L from two or more species of mammal, such as against human RANK-L and RANK-L from at least one of the species of mammal mentioned herein).

Also, again as generally described herein for the amino acid sequences of the invention, the NANOBODIES of the invention may generally be directed against any antigenic determinant, epitope, part, domain, subunit or confirmation (where applicable) of RANK-L. However, it is generally assumed and preferred that the NANOBODIES of the invention (and polypeptides comprising the same) are directed against the binding site for RANK on RANK-L or the binding site for OPG on RANK-L. In another aspect of the present invention, the amino acid sequences and polypeptides of the invention are preferably directed against an epitope on RANK-L that overlaps with the epitope of Denosumab.

As already described herein, the amino acid sequence and structure of a NANOBODY can be considered—without however being limited thereto—to be comprised of four framework regions or "FR's" (or sometimes also referred to as "FW's"), which are referred to in the art and herein as "Framework region 1" or "FR1"; as "Framework region 2" or "FR2"; as "Framework region 3" or "FR3"; and as "Framework region 4" or "FR4", respectively; which framework regions are interrupted by three complementary determining regions or "CDR's", which are referred to in the art as "Complementarity Determining Region 1" or "CDR1"; as "Complementarity Determining Region 2" or "CDR2"; and as "Complementarity Determining Region 3" or "CDR3", respectively. Some preferred framework sequences and CDR's (and combinations thereof) that are present in the NANOBODIES of the invention are as described herein. Other suitable CDR sequences can be obtained by the methods described herein.

According to a non-limiting but preferred aspect of the invention, (the CDR sequences present in) the NANOBODIES of the invention are such that:

the NANOBODIES can bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that:

the NANOBODIES can bind to RANK-L with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

the NANOBODIES can bind to RANK-L with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ s and $10^{-6}$ $s^{-1}$, such as between $10^{-4}$ $s^{-1}$ and $10^{-6}$ $s^{-1}$.

Preferably, (the CDR sequences present in) the NANOBODIES of the invention are such that: a monovalent NANOBODY of the invention (or a polypeptide that contains only one NANOBODY of the invention) is preferably such that it will bind to RANK-L with an affinity less than 500 nM, preferably less than 200 nM, more preferably less than 10 nM, such as less than 500 pM.

The affinity of the NANOBODY of the invention against RANK-L can be determined in a manner known per se, for example using the general techniques for measuring $K_D$, $K_A$, $k_{off}$ or $k_{on}$ mentioned herein, as well as some of the specific assays described herein.

Some preferred IC50 values for binding of the NANOBODIES of the invention (and of polypeptides comprising the same) to RANK-L will become clear from the further description and examples herein.

In a preferred but non-limiting aspect, the invention relates to a NANOBODY (as defined herein) against RANK-L, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
and/or
CDR2 is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and/or
CDR3 is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497;
or any suitable fragment of such an amino acid sequence.

In particular, according to this preferred but non-limiting aspect, the invention relates to a NANOBODY (as defined herein) against RANK-L, which consists of 4 framework regions (FR1 to FR4 respectively) and 3 complementarity determining regions (CDR1 to CDR3 respectively), in which:

CDR1 is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
and
CDR2 is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and
CDR3 is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497;
or any suitable fragment of such an amino acid sequences.

As generally mentioned herein for the amino acid sequences of the invention, when a NANOBODY of the invention contains one or more CDR1 sequences according to b) and/or c):

i) any amino acid substitution in such a CDR according to b) and/or c) is preferably, and compared to the corresponding CDR according to a), a conservative amino acid substitution (as defined herein);
and/or
ii) the CDR according to b) and/or c) preferably only contains amino acid substitutions, and no amino acid deletions or insertions, compared to the corresponding CDR according to a);
and/or
iii) the CDR according to b) and/or c) may be a CDR that is derived from a CDR according to a) by means of affinity maturation using one or more techniques of affinity maturation known per se.

Similarly, when a NANOBODY of the invention contains one or more CDR2 sequences according to e) and/or f):

i) any amino acid substitution in such a CDR according to e) and/or f) is preferably, and compared to the corresponding CDR according to d), a conservative amino acid substitution (as defined herein);

and/or ii) the CDR according to e) and/or f) preferably only contains amino acid substitutions, and no amino acid deletions or insertions, compared to the corresponding CDR according to d);

and/or iii) the CDR according to e) and/or f) may be a CDR that is derived from a CDR according to d) by means of affinity maturation using one or more techniques of affinity maturation known per se.

Also, similarly, when a NANOBODY of the invention contains one or more CDR3 sequences according to h) and/or i):

i) any amino acid substitution in such a CDR according to h) and/or i) is preferably, and compared to the corresponding CDR according to g), a conservative amino acid substitution (as defined herein);

and/or ii) the CDR according to h) and/or i) preferably only contains amino acid substitutions, and no amino acid deletions or insertions, compared to the corresponding CDR according to g);

and/or iii) the CDR according to h) and/or i) may be a CDR that is derived from a CDR according to g) by means of affinity maturation using one or more techniques of affinity maturation known per se.

It should be understood that the last three paragraphs generally apply to any NANOBODY of the invention that comprises one or more CDR1 sequences, CDR2 sequences and/or CDR3 sequences according to b), c), e), f), h) or i), respectively.

Of the NANOBODIES of the invention, NANOBODIES comprising one or more of the CDR's explicitly listed above are particularly preferred; NANOBODIES comprising two or more of the CDR's explicitly listed above are more particularly preferred; and NANOBODIES comprising three of the CDR's explicitly listed above are most particularly preferred.

Some particularly preferred, but non-limiting combinations of CDR sequences, as well as preferred combinations of CDR sequences and framework sequences, are mentioned in Table A-1 below, which lists the CDR sequences and framework sequences that are present in a number of preferred (but non-limiting) NANOBODIES of the invention. As will be clear to the skilled person, a combination of CDR1, CDR2 and CDR3 sequences that occur in the same clone (i.e. CDR1, CDR2 and CDR3 sequences that are mentioned on the same line in Table A-1) will usually be preferred (although the invention in its broadest sense is not limited thereto, and also comprises other suitable combinations of the CDR sequences mentioned in Table A-1). Also, a combination of CDR sequences and framework sequences that occur in the same clone (i.e. CDR sequences and framework sequences that are mentioned on the same line in Table A-1) will usually be preferred (although the invention in its broadest sense is not limited thereto, and also comprises other suitable combinations of the CDR sequences and framework sequences mentioned in Table A-1, as well as combinations of such CDR sequences and other suitable framework sequences, e.g. as further described herein).

Also, in the NANOBODIES of the invention that comprise the combinations of CDR's mentioned in Table A-1, each CDR can be replaced by a CDR chosen from the group consisting of amino acid sequences that have at least 80%, preferably at least 90%, more preferably at least 95%, even more preferably at least 99% sequence identity (as defined herein) with the mentioned CDR's; in which:

i) any amino acid substitution in such a CDR is preferably, and compared to the corresponding CDR sequence mentioned in Table A-1, a conservative amino acid substitution (as defined herein);

and/or ii) any such CDR sequence preferably only contains amino acid substitutions, and no amino acid deletions or insertions, compared to the corresponding CDR sequence mentioned in Table A-1;

and/or iii) any such CDR sequence is a CDR that is derived by means of a technique for affinity maturation known per se, and in particular starting from the corresponding CDR sequence mentioned in Table A-1.

However, as will be clear to the skilled person, the (combinations of) CDR sequences, as well as (the combinations of) CDR sequences and framework sequences mentioned in Table A-1 will generally be preferred.

TABLE A-1

Preferred combinations of CDR sequences, preferred combinations of framework sequences, and preferred combinations of framework and CDR sequences.
("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| RANKL1 | 126 EVQLVESGGGL VQAGGSLRLSC AVSGRTFS | 188 SSTMA | 250 WFRQPPG GERDFVA | 312 SISTSGTRTL YADSVKG | 374 RFTISRDNAKSTGVLQ MNSLKPEDTAVYFCAA | 436 VNRRGWE FWRLASG YDY | 498 WGLGAQVT VSS |
| RANKL2 | 127 EVQLVESGGGL VQPGGSLRLSC AASGFTFS | 189 SYYMS | 251 WVPQAPG KGLEWVS | 313 SIYSDGSTTD YADSVKG | 375 RFTISRDNAKNTLNLQ MNSLKSEDTAVYYYCAK | 437 DANSGGL EYDY | 499 WGQGTQVT VSS |
| RANKL3 | 128 EVQLVESGGKL VQAGGSLRLSC AVSGRTSS | 190 IYNMA | 252 WFRQGPG KGRESVG | 314 RIYWSDDNT YYADSVKG | 376 RFTISRDNATNTVYLQ MNSLKPEDTAVYYCAG | 438 KTTKWSLE YDY | 500 WGQGTQVT VSS |
| RANKL4 | 129 KVQLVESGGGL VQTGDSLRLSC AASGRAIG | 191 SYAMG | 253 WFRQAPG KEREFVA | 315 VINYRGSSLK YADRVKG | 377 RFTISRDNAKNMVYLQ MNSLKPDDTAVYYCAA | 439 QTSGADF GTTPQRY TY | 501 WGQGTQVT VSS |
| RANKL5 | 130 EVQLVESGGGL VQAGGSLRLSC AASGRTIG | 192 GHTMA | 254 WFRQAPG KERDFVA | 316 TITSSGSTIFY ADSVKG | 378 RFTISRDNGKKTMTLE MDSLKPEDTAVYYCAA | 440 RIRGKVTV DNFDYAY | 502 WGQGTQVT VSS |
| RANKL6 | 131 EVQLVESGGGL MQTGGSLRLS CAASGVTYS | 193 YYTAS | 255 WFRQAPG KEREFVA | 317 AISPSGNTYY ADSVKG | 379 RFTISRDNGKHTMYLQ MNSLNPEDTAVYFCAI | 441 RATDSIYY ASSYRH | 503 WGQGTQVT VSS |
| RANKL7 | 132 EVQLVESEGGP VQSGGSLRLSC AASGRTFS | 194 VSTIA | 256 WFRQAPG EGREFVA | 318 AIYPSGRNAY VADSVKG | 380 RFTISRDNAKKTVYLQ MNSLKPEDTAAYYCAA | 442 HQPSGSY YSAEAYAY | 504 WGQGTQVT VSS |
| RANKL8 | 133 EVQLVESGGGG SVQPGGSLRLS CAASGGTFS | 195 RYAMG | 257 WFRQAPG KEREFVS | 319 AISVGGTYQ YYVDSVKG | 381 RFTISRDNAESTVYLQ MNSLKPEDTAVYYCAG | 443 DASPYGYL REYTATRF DY | 505 WGQGTQVT VSS |
| RANKL9 | 134 EVQLVESGGGL VQAGGSLRLTC AASGRTFR | 196 SYAMG | 258 WFRQAPG KEREFVA | 320 AINYSGGST NYADSVKG | 382 RFTISRDNAKNTLYLQ MNSLKPEDTAVYYCAA | 444 GSGYASL SYYSTERA YTY | 506 WGQGTQVT VSS |
| RANKL10 | 135 EVQLVESGGGL VQAGGSLRLSC AASGITFS | 197 SRTMG | 259 WFRQAPG KEREFVA | 321 AITPSSRTTY YADSVKG | 383 RFTISRDNAKNTVLLQ MNSLEPEDTAVYYCAA | 445 ERTYGSN YTRPTAW NY | 507 WGQGTQVT VSS |
| RANKL11 | 136 EVQLVESGGGL VQAGGSLRLSC AASGRTFS | 198 SKTMG | 260 WFRQPPG NEREFVA | 322 AITPSRTTY YADSVKG | 384 RFTISRDNAKNTVSLQ MNSLKPEDTAAYYCVA | 446 VRRYGSP PHDGSSY EY | 508 WGQGTQVT VSS |

TABLE A-1-continued

Preferred combinations of CDR sequences, preferred combinations of framework sequences, and preferred combinations of framework and CDR sequences.
("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| RANKL12 | 137 EVQLVESGGGL WMQAGGSLRL SCAASGRTFT | 199 MA | 261 WFRQAPG KEREFVA | 323 AITGSGRSTY YTDSVKG | 385 RFTISRDNAKNTAYLQ MKSLKPEDTAVYYCAG | 447 LRGLGLEY DSAKSYSY | 509 WGQGTQVT VSS |
| RANKL13 | 138 EVQLVESGGGL VQAGGSLRLSC AASGRTFR | 200 SYPMG | 262 WFRQAPG KEREFVA | 324 SITGSGGSTY YADSVKG | 386 RFTISRDNAKNTVLIQ MNSLRPEDTAVYYCAA | 448 YIRPDTYL SRDYRKY DY | 510 WGQGTQVT VSS |
| RANKL14 | 139 EVQLVESGGGL VQAGGSLRLSC AASGRTSS | 201 YYTMS | 263 WFRQDPG KEREFVA | 325 AVPLSGNTY YADPVRG | 387 RFTISRDNAKNTADLQ MNSLKPEDTAVYYCAA | 449 RASGSIYN RGSYAY | 511 WGQGTQVT VSS |
| RANKL15 | 140 EVQLVESGGGL VQAGGSLRLSC AAAGGTFR | 202 NVMG | 264 WFRQAPG KEREFVT | 326 AISTGGSWT GYVDSVKD | 388 RFTISRDNTKQTVLIQ MASLKPEDTAVYYCAA | 450 TTPATTYL PRSERQY DY | 512 WGQGTQVT VSS |
| RANKL16 | 141 EVQLVESGGGL VQAGGSLRLSC VASRRTFS | 203 SYAMG | 265 WFRQVPG KERDFVA | 327 AISTGSITIYG DSVKG | 389 RFTISRDNAKNTVLIQ MNSLKPEDTAVYYCAA | 451 GKREPYL RQTASN PYDY | 513 WGQGTQVT VSS |
| RANKL17 | 142 EVQLVESGGGL VQVGDSLRLSC EASGR.SRF | 204 STYVMG | 266 WFRQAPG KEREFVA | 328 AVSWSSGNA YYDSAKG | 390 RFATSRDTAKNIMYLQ MNSLKPEDTAVYYCAA | 452 GRGYGLL SEYTQAP RYDY | 514 WGQGTQVT VSS |
| RANKL18 | 143 EVQLVESGGGL VQAGGSLRLSC AASGRTFS | 205 RSAMG | 267 WFRQAPG KEREFVG | 329 FITGSGGTTY YGESVKG | 391 RFTISRDNAQNPVLIQ MNSLKPEDTAVYYCGV | 453 YRRTYISS TYSESSEY DY | 515 WGQGTQVT VSS |
| RANKL19 | 144 EVQLVESGGGL VQAGGSLRLSC AASGRTVT | 206 MG | 268 WFRQAPG KEREFVA | 330 SITGSGSVTN YADSVKG | 392 RFTISRDNAKNTVFLQ MNSLKPEDTAVYYCAA | 454 YLPSPYYS SYYDSTKY EY | 516 WGQGTQVT VSS |
| RANKL20 | 145 EVQLVESGGGL VQAGDSLRLSC AASGRTFT | 207 MG | 269 WFRQAPG TEREFVA | 331 AISGSGKITN YADSVKG | 393 RFTISRDHAKNTVFLQ MDSLKPEDTAVYYCAG | 455 YLRSPYYS SFYDSAKY EY | 517 WGQGTQVT VSS |
| RANKL21 | 146 EVQLVESGGGL VQAGGSLRLSC VASRRTFN | 208 SYAVG | 270 WFRQVPG EERDFVA | 332 AISTGSVTIY ADSVKG | 394 RFTISRDNAKNTVLIQ MNSLKPEDTAVYYCAA | 456 GNREPYL RQTASN PYDY | 518 WGQGTQVT VSS |
| RANKL22 | 147 EVQLVESGGGL MQTGGSLRLS CAASERTSR | 209 NYGMG | 271 WFRQAPG KEREFVA | 333 AITSAGGTTY YGDFVKG | 395 RFTISRDSAKYTVLIQ MNSLKPEDTAVYWCA A | 457 KLQIGGR WHNLNDY GY | 519 RGQGTQVT VSS |

TABLE A-1-continued

Preferred combinations of CDR sequences, preferred combinations of framework sequences, and preferred combinations of framework and CDR sequences.
("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| RANKL23 | 148 EVQLVESGGGL VQAGGSLRLSC AASGLTT | 210 VYTMA | 272 WFRQAPG KEREFVA | 334 AITRSGKTTY YADSVKG | 396 RFTISRDNAKNTVNLQ MNSLKPDDTAVYYCAA | 458 KALLGMTN PAGYEY | 520 WGQETQVT VSS |
| RANKL 3D4 | 149 EVQLVEAGGGL VQAGDSLRLSC AASGRTIR | 211 GTMA | 273 WFRQAPG KDREFVA | 335 TVTSSGSTTF YADSVKG | 397 RFTISRDNAENTVNLQ MDSLKPEDTAVYYCAA | 459 RIRGKVTP SNYDYAY | 521 WGQGTQVT VSS |
| RANKL PMP4B3 | 150 evqlvesggw mqaggslrlsc aasgrtft | 212 MA | 274 wfrqasg kerefva | 336 AITGSGRSTY YTDSVKG | 398 rftisrdnakntayl q mkslkpedtavyycag | 460 LRGLGLEY DSAKSYSY | 522 wgqgtqvt vss |
| RANKL PMP2E11 | 151 EVQLVESGGGL VQAGGSLRLSC AASGRTFR | 213 SYPMG | 275 WFRQAPG KEREFVA | 337 SITGSGGSTY YADSVKG | 399 RFTISRDNAKNTVLQ MNSLRPEDTAVYCCAA | 461 YIRPDTYL SRDYRKY DY | 523 WGQGTQVT VSS |
| RANKL PMP2A6 | 152 evqlvesggg l vqaggslrlsc aasglt | 214 RYTMS | 276 wfrqdpg kerefva | 338 AVPLSGNTY YADPVRG | 400 rftisrdnakntvdlq mnslkpedtavyycaa | 462 RASGGIFN RGSYAY | 524 wgqgtqvt vss |
| RANKL PMP1F2 | 153 evqlvesggg l vpaggslrlsc aasgltdr | 215 RYTMS | 277 wfrqdpg kerefva | 339 AVPLSGNTY YADPVRG | 401 rftisrdnakntvdlq mnslkpedtavyycaa | 463 RASGGIFN RGSYAY | 525 wgqgtqvt vss |
| RANKL PMP2D4 | 154 evqlvesggg l vpaggslrlsc aasgltdr | 216 RYTMS | 278 wfrqdpg kerefva | 340 AVPLSGNTY YADPVRG | 402 rftisrdnakntvdlq mnslkpedtavyycaa | 464 RASGGIFN RGSYAY | 526 wgqgtqvt vss |
| RANKL PMP7B2 | 155 evqlvesggg l vqaggslrlsc aaagtfr | 217 NVVMG | 279 wfrqapg kerefvt | 341 AISTGGSWT GYVDSVKD | 403 rftisrdntkntvylq maslkpedtavyycaa | 465 TMPATTYL PRSERQY DY | 527 wgqgtqvt vss |
| RANKL PMP7A11 | 156 evqlvesggg l vqaggsltlsc aaagfttfr | 218 RVVMG | 280 wfrqapg kerefva | 342 AISTGGTWT GYVDSVKD | 404 rftisrdntkntvylq maslkpedtavyncaa | 466 TTPTTSYL PRSERQY EY | 528 wgqgtqvt vss |
| RANKL PMP7F1 | 157 evqlvesggg l vqaggslrlsc aaagtfr | 219 NVVMG | 281 wfrqapg kerefvt | 343 AISTGGTWT GYVDSVKD | 405 rftisrdntkntvnlq maslkpedtavyycaa | 467 TTPTTSYL PRSERQY EY | 529 wgqgtqvt vss |
| RANKL PMP7H5 | 158 evqlvesggg l vqaggslrlsc aaagtfr | 220 NVVMG | 282 wfrqapg kerefva | 344 AISTGGSWT GYVDSVKD | 406 rftisrdntkntvylq mvslkpedtavyycaa | 468 TTPATTYL PRSERQY DY | 530 wgqgtqvt vss |

TABLE A-1-continued

Preferred combinations of CDR sequences, preferred combinations of framework sequences, and preferred combinations of framework and CDR sequences.
("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| RANKL PMP7E7 | 159 evqlvesgggl vqaggslrlsc aaaggtfr | 221 NYVMG | 283 wfrqapg kerefvt | 345 AISAGGSWT GYVDSVKD | 407 rftisrdntkntvylq maslkpedtavyycaa | 469 TTPATTYL PRSERQY DY | 531 wgqgtgvtv vss |
| RANKL PMP7E2 | 160 evqlvesgggl vqaggslrlsc aaagytfr | 222 AYVMG | 284 wfrqapg kerefva | 346 GISTGGTWT GYVDSVKD | 408 rftisrdntkntvylq maslkpedtavyycaa | 470 TTPVTSYL PRSERQY EH | 532 wgqgtgvt vss |
| RANKL PMP3H10 | 161 evqlvesgggl vqsggslrlsc aaagytfr | 223 ARAYVM G | 285 wfrqapg kerefva | 347 AISTGGTWT GYVDSVKD | 409 rftisrdntkntmylq maslkpedtavyycaa | 471 TTPSTSYL PRSERQY EY | 533 wgqgtgvt vss |
| RANKL PMP7F9 | 162 evqlvesgggl vqaggslrlsc vasrrtfs | 224 SYAMG | 286 wfrqvpg kerdfva | 348 AISTGSITIYG DSVKG | 410 rftisrdnakntvylq mnslkpedtavyycaa | 472 GKREPYL RQTASN PYDY | 534 wgqgtgvt vss |
| RANKL PMP7E6 | 163 evqlvesgggl vqaggslrlsc vaskrtfa | 225 SYAMG | 287 wfrqvpg kerdfva | 349 AITTGSITIYA DSVKG | 411 rfaisrdnakntvylq mnslkpedtavyycaa | 473 GNREPYL RQTASN PYDY | 535 wgqgtgvt vss |
| RANKL PMP4F4 | 164 evqlvesgggl vqvgdslrlsc easgrsrf | 226 STYVMG | 288 wfrqapg kerefva | 350 AVSWSSGNA YYIDSAKG | 412 rfatsrdtaknimylq mnslkpedtavytcaa | 474 GRGYGLL SEYTQAP RYDY | 536 wgqgtgvt vss |
| RANKL PMP7B11 | 165 evqlvesgggl vqvgdslrlsc easgrsrf | 227 STYVMG | 289 wfrqapg kerefva | 351 AISWSSGNA YYIDSAKG | 413 rfatsrdtaknimylq mnslkpedtavyscaa | 475 GRGYGLL SEYTQAA RYDY | 537 wgqgtgvt vss |
| RANKL PMP9H9 | 166 evqlvesgggl vqaggslrlsc aasgrtfs | 228 RSAMG | 290 wfrqapg kerefvg | 352 FITGSGGTTY YGESVKG | 414 rftisrdnaqnpvylq mnslkpedtavyycgv | 476 YRRTYISS TYSESSEY DY | 538 wgqgtgvt vss |
| RANKL PMP9G3 | 167 evqlvesgggl vqaggslrlsc aasgrtfs | 229 RSAMG | 291 wfrqapg kerefvg | 353 FITGSGGTTY YGESVKG | 415 rftisrdnaqnpvylq mnslkpedtavyycav | 477 YRRTYISS TYNESSEY DY | 539 wgqgtgvt vss |
| RANKL PMP9E3 | 168 evqlvesgggl vqaggslrlsc aasgrtfs | 230 RSAMG | 292 wfrqapg kerefvg | 354 FITGSGGTTY YGESVKG | 416 rftisrdnaqnpvylq mnslkpedtavyycgv | 478 YRRTYISS TYSESSEY DY | 540 wgqgtgvt vss |
| RANKL PMP7H9 | 169 evqlvesgggl vqaggslrlsc aasgrtfs | 231 RSAMG | 293 wfrqapg kerefvg | 355 FITGSGGTTY YGESVKG | 417 rftisrdnaqnpvylq mnslkpedtavyycgv | 479 YRRTY- ISIT YSESSDY DY | 541 wgqgtgvt vss |

TABLE A-1-continued

Preferred combinations of CDR sequences, preferred combinations of framework sequences, and preferred combinations of framework and CDR sequences.
("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| RANKL PMP4C3 | 170 evqlvesggglvqaggslrlscaasgrtfs | 232 ISAMG | 294 wfrqapgkerefvc | 356 FITGSGGTTYYGESVKG | 418 rftisrdnaqnpvylqmnslkpedtavyycgv | 480 YRRTYISSTYSESSEYDY | 542 wgqgtqvtvss |
| RANKL PMP9G6 | 171 evqlvesggglvqaggslrlscaasgrtfs | 233 RSAMG | 295 wfrqapgkerefvg | 357 FITGSGGTTYYGESVKG | 419 rftisrdnaqnpvylqmnslkpedtavyycgv | 481 YRRTYISSTYSESSEYDY | 543 wgqgtqvtvss |
| RANKL PMP7B12 | 172 evqlvesggglvqaggslrlscaasgrtfs | 234 RSAMG | 296 wfrqapgkerefvg | 358 FITGSGGTTYYGESVKG | 420 rftisrdnaqnpvylqmnslkpedtavyycgv | 482 YRRTYISSTYSESSEYDY | 544 wgqgtqvtvss |
| RANKL PMP7G3 | 173 evqlvesggglvqaggslrlscaasgrtfs | 235 RSAMG | 297 wfrqapgkerefvg | 359 FITGSGGTTYYGESVKG | 421 rftisrdnaqnpvylqmnslkpedtavyycav | 483 YRRTYISSTYNESSEYDY | 545 wgqgtqvtvss |
| RANKL PMP9C12 | 174 evqlvesggglvqaggslrlscaasgrtfs | 236 RSAMG | 298 wfrqapgkerefvg | 360 FITGSGGTTYYGESVKG | 422 rftisrdnaqnpvylqmnslkpedtavyycgv | 484 YRRTYISSTYSESSEYDY | 546 wgqgtqvtvss |
| RANKL PMP1D8 | 175 evqlvesggglvqagdslrlscaasgrtfs | 237 MG | 299 wfrqapgkerefva | 361 AISGSGGSITNYADSVKG | 423 rftisrdyakttvflqmnslkpedtavyycaa | 485 YVRTPYYSSYYDSTKYEY | 547 wgqgtqvtvss |
| RANKL PMP1A2 | 176 evqlvesggglvqagdslrlscaasgrtfs | 238 MG | 300 wfrqapgkerefva | 362 FISGSGSVTNYTDSVKG | 424 rftisrdhakntvflqmnslkpedtavyycaa | 486 YLRGPYYSSFYDSTKYEY | 548 wgqgtqvtvss |
| RANKL PMP1E5 | 177 evqlvesggglvqagdslrlscaasgrtft | 239 MG | 301 wfrraqpgterefva | 363 SISGSGKITNYADSVKG | 425 rftisrdhaknavflqmdglkpedtavyycaa | 487 YLRSPYYSSYDSAKYEY | 549 wgqgtqvtvss |
| RANKL PMP2B8 | 178 evqlvesgggsvqagdslrlscaasgrtft | 240 MG | 302 wfrqapgterefva | 364 AISGSGKITNYADSVKG | 426 rftisrdhamntvflqmdslkpedtavyycaa | 488 YLRSPYYSSYDSAKYEY | 550 wgqgtqvtvss |
| RANKL PMP2C5 | 179 evqlvesggglvqagdslrlscaasgrtft | 241 MG | 303 wfrqapgterefva | 365 AISGSGKITNYADSVKG | 427 rftisrdhakntvflqmdslkpedtavyycaa | 489 YLRSPYYSSYDSAKYEY | 551 wgqgtqvtvss |
| RANKL PMP2B4 | 180 evqlvesggglvqagdslrlscaasgrtft | 242 MG | 304 wfrqapgterefva | 366 AISGSGKITNYADSVKG | 428 rftisrdhakntvflqmdslkpedtavyycaa | 490 YLRSPYYSSYDSAKYEY | 552 wgqgtqvtvss |

TABLE A-1-continued

Preferred combinations of CDR sequences, preferred combinations of framework sequences, and preferred combinations of framework and CDR sequences.
("ID" refers to the SEQ ID NO in the attached sequence listing)

| Clone | ID FR1 | ID CDR 1 | ID FR2 | ID CDR 2 | ID FR3 | ID CDR 3 | ID FR4 |
|---|---|---|---|---|---|---|---|
| RANKL PMP2A5 | 181 evqlvesgggl vqagdslrlsc aasgrtft | 243 MG | 305 wfrqapg terefva | 367 AISGSGKITN YADSVKG | 429 rftisrdhakntvflq mdslkpedtavyycaa | 491 YLRSPYYS SYDSAKY EY | 553 wgqgtqvt vss |
| RANKL PMP2D7 | 182 evqlvesgggl vqagdslrlsc aasgrtft | 244 MG | 306 wfrqapg terefva | 368 AISGSGKITN YADSVKG | 430 rftisrdhakntvflq mdslkpedtavyycaa | 492 YLRSPYYS SYDSAKY EY | 554 wgqgtqvt vss |
| RANKL PMP2G4 | 183 evqlvesgggl vqagdslrlsc aasgrtft | 245 MG | 307 wfrqapg terefva | 369 AISGSGKITN YADSVKG | 431 rftisrdhakntvflq mdslkpedtavyycaa | 493 YLRSPYYS SYDSAKY EY | 555 wgqgtqvt vss |
| RANKL PMP7A8 | 184 emqlvesggl vqaggslrlsc vaskrtfa | 246 SYAMG | 308 wfrqvpg kerdfva | 370 AISTHSITVVA DSVKG | 432 rftisrdnakntvylq mntlkpedtavyycaa | 494 GNREPYL RQTASN PYDY | 556 wgqgtqvt vss |
| RANKL PMP7A5 | 185 evqlvesgggl vqtggslrlsc vasrrtfs | 247 SYAVG | 309 wfrqvpg kerdfva | 371 AISTGSVTIY ADSVKG | 433 rftisrdntkntvylq mnslkpedtavyycaa | 495 GNREPYL RQTASN PYDY | 557 wgqgtqvt vss |
| RANKL PMP7F8 | 186 EVQLVESGGGL VQAGGSLRLSC AAAGGTFR | 248 NVVMG | 310 WFRQAPG KEREFVT | 372 AISTGGSWT GYVDSVKD | 434 RFTISRDNTKNTVYLH MASLKPEDTAVYYCAA | 496 TTPVTTYL PRSERQY DY | 558 WGQGTQVT VSS |
| RANKL PMP7F6 | 187 EVQLVESGGGL VQAGDSLRLSC AAAGGTFR | 249 RVVMG | 311 WFRQAPG KEREFVA | 373 AISTGGTWT GYVDSVKD | 435 RFTISRDNTKNTVYLQ MASLKPEDTAVYNCAA | 497 TTPTTSYL PRSERQY EY | 559 WGQGTQVT VSS |

Thus, in the NANOBODIES of the invention, at least one of the CDR1, CDR2 and CDR3 sequences present is suitably chosen from the group consisting of the CDR1, CDR2 and CDR3 sequences, respectively, listed in Table A-1; or from the group of CDR1, CDR2 and CDR3 sequences, respectively, that have at least 80%, preferably at least 90%, more preferably at least 95%, even more preferably at least 99% "sequence identity" (as defined herein) with at least one of the CDR1, CDR2 and CDR3 sequences, respectively, listed in Table A-1; and/or from the group consisting of the CDR1, CDR2 and CDR3 sequences, respectively, that have 3, 2 or only 1 "amino acid difference(s)" (as defined herein) with at least one of the CDR1, CDR2 and CDR3 sequences, respectively, listed in Table A-1.

In this context, by "suitably chosen" is meant that, as applicable, a CDR1 sequence is chosen from suitable CDR1 sequences (i.e. as defined herein), a CDR2 sequence is chosen from suitable CDR2 sequences (i.e. as defined herein), and a CDR3 sequence is chosen from suitable CDR3 sequence (i.e. as defined herein), respectively. More in particular, the CDR sequences are preferably chosen such that the NANOBODIES of the invention bind to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein.

In particular, in the NANOBODIES of the invention, at least the CDR3 sequence present is suitably chosen from the group consisting of the CDR3 sequences listed in Table A-1 or from the group of CDR3 sequences that have at least 80%, preferably at least 90%, more preferably at least 95%, even more preferably at least 99% sequence identity with at least one of the CDR3 sequences listed in Table A-1; and/or from the group consisting of the CDR3 sequences that have 3, 2 or only 1 amino acid difference(s) with at least one of the CDR3 sequences listed in Table A-1.

Preferably, in the NANOBODIES of the invention, at least two of the CDR1, CDR2 and CDR3 sequences present are suitably chosen from the group consisting of the CDR1, CDR2 and CDR3 sequences, respectively, listed in Table A-1 or from the group consisting of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1; and/or from the group consisting of the CDR1, CDR2 and CDR3 sequences, respectively, that have 3, 2 or only 1 "amino acid difference(s)" with at least one of the CDR1, CDR2 and CDR3 sequences, respectively, listed in Table A-1.

In particular, in the NANOBODIES of the invention, at least the CDR3 sequence present is suitably chosen from the group consisting of the CDR3 sequences listed in Table A-1 or from the group of CDR3 sequences that have at least 80%, preferably at least 90%, more preferably at least 95%, even more preferably at least 99% sequence identity with at least one of the CDR3 sequences listed in Table A-1, respectively; and at least one of the CDR1 and CDR2 sequences present is suitably chosen from the group consisting of the CDR1 and CDR2 sequences, respectively, listed in Table A-1 or from the group of CDR1 and CDR2 sequences, respectively, that have at least 80%, preferably at least 90%, more preferably at least 95%, even more preferably at least 99% sequence identity with at least one of the CDR1 and CDR2 sequences, respectively, listed in Table A-1; and/or from the group consisting of the CDR1 and CDR2 sequences, respectively, that have 3, 2 or only 1 amino acid difference(s) with at least one of the CDR1 and CDR2 sequences, respectively, listed in Table A-1.

Most preferably, in the NANOBODIES of the invention, all three CDR1, CDR2 and CDR3 sequences present are suitably chosen from the group consisting of the CDR1, CDR2 and CDR3 sequences, respectively, listed in Table A-1 or from the group of CDR1, CDR2 and CDR3 sequences, respectively, that have at least 80%, preferably at least 90%, more preferably at least 95%, even more preferably at least 99% sequence identity with at least one of the CDR1, CDR2 and CDR3 sequences, respectively, listed in Table A-1; and/or from the group consisting of the CDR1, CDR2 and CDR3 sequences, respectively, that have 3, 2 or only 1 amino acid difference(s) with at least one of the CDR1, CDR2 and CDR3 sequences, respectively, listed in Table A-1.

Even more preferably, in the NANOBODIES of the invention, at least one of the CDR1, CDR2 and CDR3 sequences present is suitably chosen from the group consisting of the CDR1, CDR2 and CDR3 sequences, respectively, listed in Table A-1. Preferably, in this aspect, at least one or preferably both of the other two CDR sequences present are suitably chosen from CDR sequences that have at least 80%, preferably at least 90%, more preferably at least 95%, even more preferably at least 99% sequence identity with at least one of the corresponding CDR sequences, respectively, listed in Table A-1; and/or from the group consisting of the CDR sequences that have 3, 2 or only 1 amino acid difference(s) with at least one of the corresponding sequences, respectively, listed in Table A-1.

In particular, in the NANOBODIES of the invention, at least the CDR3 sequence present is suitably chosen from the group consisting of the CDR3 listed in Table A-1. Preferably, in this aspect, at least one and preferably both of the CDR1 and CDR2 sequences present are suitably chosen from the groups of CDR1 and CDR2 sequences, respectively, that have at least 80%, preferably at least 90%, more preferably at least 95%, even more preferably at least 99% sequence identity with the CDR1 and CDR2 sequences, respectively, listed in Table A-1; and/or from the group consisting of the CDR1 and CDR2 sequences, respectively, that have 3, 2 or only 1 amino acid difference(s) with at least one of the CDR1 and CDR2 sequences, respectively, listed in Table A-1.

Even more preferably, in the NANOBODIES of the invention, at least two of the CDR1, CDR2 and CDR3 sequences present are suitably chosen from the group consisting of the CDR1, CDR2 and CDR3 sequences, respectively, listed in Table A-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1; and/or from the group consisting of CDR sequences that have 3, 2 or only 1 amino acid difference(s) with at least one of the corresponding sequences listed in Table A-1.

In particular, in the NANOBODIES of the invention, at least the CDR3 sequence is suitably chosen from the group consisting of the CDR3 sequences listed in Table A-1, and either the CDR1 sequence or the CDR2 sequence is suitably chosen from the group consisting of the CDR1 and CDR2 sequences, respectively, listed in Table A-1. Preferably, in this aspect, the remaining CDR sequence present is suitably chosen from the group of CDR sequences that have at least 80%, preferably at least 90%, more preferably at least 95%, even more preferably at least 99% sequence identity with at least one of the corresponding CDR sequences listed in Table A-1; and/or from the group consisting of CDR sequences that have 3, 2 or only 1 amino acid difference(s) with the corresponding CDR sequences listed in Table A-1.

Even more preferably, in the NANOBODIES of the invention, all three CDR1, CDR2 and CDR3 sequences present are suitably chosen from the group consisting of the CDR1, CDR2 and CDR3 sequences, respectively, listed in Table A-1.

Also, generally, the combinations of CDR's listed in Table A-1 (i.e. those mentioned on the same line in Table A-1) are preferred. Thus, it is generally preferred that, when a CDR in a NANOBODY of the invention is a CDR sequence mentioned in Table A-1 or is suitably chosen from the group of CDR sequences that have at least 80%, preferably at least 90%, more preferably at least 95%, even more preferably at least 99% sequence identity with a CDR sequence listed in Table A-1; and/or from the group consisting of CDR sequences that have 3, 2 or only 1 amino acid difference(s) with a CDR sequence listed in Table A-1, that at least one and preferably both of the other CDR's are suitably chosen from the CDR sequences that belong to the same combination in Table A-1 (i.e. mentioned on the same line in Table A-1) or are suitably chosen from the group of CDR sequences that have at least 80%, preferably at least 90%, more preferably at least 95%, even more preferably at least 99% sequence identity with the CDR sequence(s) belonging to the same combination and/or from the group consisting of CDR sequences that have 3, 2 or only 1 amino acid difference(s) with the CDR sequence(s) belonging to the same combination. The other preferences indicated in the above paragraphs also apply to the combinations of CDR's mentioned in Table A-1.

Thus, by means of non-limiting examples, a NANOBODY of the invention can for example comprise a CDR1 sequence that has more than 80% sequence identity with one of the CDR1 sequences mentioned in Table A-1, a CDR2 sequence that has 3, 2 or 1 amino acid difference with one of the CDR2 sequences mentioned in Table A-1 (but belonging to a different combination), and a CDR3 sequence.

Some preferred NANOBODIES of the invention may for example comprise: (1) a CDR1 sequence that has more than 80% sequence identity with one of the CDR1 sequences mentioned in Table A-1; a CDR2 sequence that has 3, 2 or 1 amino acid difference with one of the CDR2 sequences mentioned in Table A-1 (but belonging to a different combination); and a CDR3 sequence that has more than 80% sequence identity with one of the CDR3 sequences mentioned in Table A-1 (but belonging to a different combination); or (2) a CDR1 sequence that has more than 80% sequence identity with one of the CDR1 sequences mentioned in Table A-1; a CDR2 sequence, and one of the CDR3 sequences listed in Table A-1; or (3) a CDR1 sequence; a CDR2 sequence that has more than 80% sequence identity with one of the CDR2 sequence listed in Table A-1; and a CDR3 sequence that has 3, 2 or 1 amino acid differences with the CDR3 sequence mentioned in Table A-1 that belongs to the same combination as the CDR2 sequence.

Some particularly preferred NANOBODIES of the invention may for example comprise: (1) a CDR1 sequence that has more than 80% sequence identity with one of the CDR1 sequences mentioned in Table A-1; a CDR2 sequence that has 3, 2 or 1 amino acid difference with the CDR2 sequence mentioned in Table A-1 that belongs to the same combination; and a CDR3 sequence that has more than 80% sequence identity with the CDR3 sequence mentioned in Table A-1 that belongs to the same combination; (2) a CDR1 sequence; a CDR 2 listed in Table A-1 and a CDR3 sequence listed in Table A-1 (in which the CDR2 sequence and CDR3 sequence may belong to different combinations).

Some even more preferred NANOBODIES of the invention may for example comprise: (1) a CDR1 sequence that has more than 80% sequence identity with one of the CDR1 sequences mentioned in Table A-1; the CDR2 sequence listed in Table A-1 that belongs to the same combination; and a CDR3 sequence mentioned in Table A-1 that belongs to a different combination; or (2) a CDR1 sequence mentioned in Table A-1; a CDR2 sequence that has 3, 2 or 1 amino acid differences with the CDR2 sequence mentioned in Table A-1 that belongs to the same combination; and a CDR3 sequence that has more than 80% sequence identity with the CDR3 sequence listed in Table A-1 that belongs to the same or a different combination.

Particularly preferred NANOBODIES of the invention may for example comprise a CDR1 sequence mentioned in Table A-1, a CDR2 sequence that has more than 80% sequence identity with the CDR2 sequence mentioned in Table A-1 that belongs to the same combination; and the CDR3 sequence mentioned in Table A-1 that belongs to the same combination.

In the most preferred NANOBODIES of the invention, the CDR1, CDR2 and CDR3 sequences present are suitably chosen from one of the combinations of CDR1, CDR2 and CDR3 sequences, respectively, listed in Table A-1.

According to another preferred, but non-limiting aspect of the invention (a) CDR1 has a length of between 1 and 12 amino acid residues, and usually between 2 and 9 amino acid residues, such as 5, 6 or 7 amino acid residues; and/or (b) CDR2 has a length of between 13 and 24 amino acid residues, and usually between 15 and 21 amino acid residues, such as 16 and 17 amino acid residues; and/or (c) CDR3 has a length of between 2 and 35 amino acid residues, and usually between 3 and 30 amino acid residues, such as between 6 and 23 amino acid residues.

In another preferred, but non-limiting aspect, the invention relates to a NANOBODY in which the CDR sequences (as defined herein) have more than 80%, preferably more than 90%, more preferably more than 95%, such as 99% or more sequence identity (as defined herein) with the CDR sequences of at least one of the amino acid sequences of SEQ ID NO's: 560-621.

Generally, NANOBODIES with the above CDR sequences may be as further described herein, and preferably have framework sequences that are also as further described herein. Thus, for example and as mentioned herein, such NANOBODIES may be naturally occurring NANOBODIES (from any suitable species), naturally occurring $V_{HH}$ sequences (i.e. from a suitable species of Camelid) or synthetic or semi-synthetic amino acid sequences or NANOBODIES, including but not limited to partially humanized NANOBODIES or $V_{HH}$ sequences, fully humanized NANOBODIES or $V_{HH}$ sequences, camelized heavy chain variable domain sequences, as well as NANOBODIES that have been obtained by the techniques mentioned herein.

Thus, in one specific, but non-limiting aspect, the invention relates to a humanized NANOBODY, which consists of 4 framework regions (FR1 to FR4 respectively) and 3 complementarity determining regions (CDR1 to CDR3 respectively), in which CDR1 to CDR3 are as defined herein and in which said humanized NANOBODY comprises at least one humanizing substitution (as defined herein), and in particular at least one humanizing substitution in at least one of its framework sequences (as defined herein).

In another preferred, but non-limiting aspect, the invention relates to a NANOBODY in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 560-621. This degree of amino acid identity can for example be determined by determining the degree of amino acid identity (in a manner described herein) between said NANOBODY and one or more of the sequences of SEQ ID NO's: 560-621, in which the amino acid residues that form the framework regions are disregarded. Such NANOBODIES can be as further described herein.

In another preferred, but non-limiting aspect, the invention relates to a NANOBODY with an amino acid sequence that is chosen from the group consisting of SEQ ID NO's: 560-621 or from the group consisting of from amino acid sequences that have more than 80%, preferably more than 90%, more preferably more than 95%, such as 99% or more sequence identity (as defined herein) with at least one of the amino acid sequences of SEQ ID NO's: 560-621.

Another preferred, but non-limiting aspect of the invention relates to humanized variants of the NANOBODIES of SEQ ID NO's: 560-621, that comprise, compared to the corresponding native $V_{HH}$ sequence, at least one humanizing substitution (as defined herein), and in particular at least one humanizing substitution in at least one of its framework sequences (as defined herein). Some preferred, but non-limiting examples of such humanized variants are the humanized NANOBODIES of SEQ ID NO's: 730-757 and 765. Thus, the invention also relates to a humanized NANOBODY with an amino acid sequence that is chosen from the group consisting of SEQ ID NO's: 730-757 and 765 or from the group consisting of from amino acid sequences that have more than 80%, preferably more than 90%, more preferably more than 95%, such as 99% or more sequence identity (as defined herein) with at least one of the amino acid sequences of SEQ ID NO's: 730-757 and 765 (in which amino acid sequences that are chosen from the latter group of amino acid sequences may contain a greater number or a smaller number of humanizing substitutions compared to the corresponding sequence of SEQ ID NO's: 730-757 and 765, as long as they retain at least one of the humanizing substitutions present in the corresponding sequence of SEQ ID NO's: 730-757 and 765).

The polypeptides of the invention comprise or essentially consist of at least one NANOBODY of the invention. Some preferred, but non-limiting examples of polypeptides of the invention are given in SEQ ID NO's: 622-729, 759-762 and 766-789.

It will be clear to the skilled person that the NANOBODIES that are mentioned herein as "preferred" (or "more preferred", "even more preferred", etc.) are also preferred (or more preferred, or even more preferred, etc.) for use in the polypeptides described herein. Thus, polypeptides that comprise or essentially consist of one or more "preferred" NANOBODIES of the invention will generally be preferred, and polypeptides that comprise or essentially consist of one or more "more preferred" NANOBODIES of the invention will generally be more preferred, etc.

Generally, proteins or polypeptides that comprise or essentially consist of a single NANOBODY (such as a single NANOBODY of the invention) will be referred to herein as "monovalent" proteins or polypeptides or as "monovalent constructs". Proteins and polypeptides that comprise or essentially consist of two or more NANOBODIES (such as at least two NANOBODIES of the invention or at least one NANOBODY of the invention and at least one other NANOBODY) will be referred to herein as "multivalent" proteins or polypeptides or as "multivalent constructs", and these may provide certain advantages compared to the corresponding monovalent NANOBODIES of the invention. Some non-limiting examples of such multivalent constructs will become clear from the further description herein.

According to one specific, but non-limiting aspect, a polypeptide of the invention comprises or essentially consists of at least two NANOBODIES of the invention, such as two or three NANOBODIES of the invention. As further described herein, such multivalent constructs can provide certain advantages compared to a protein or polypeptide comprising or essentially consisting of a single NANOBODY of the invention, such as a much improved avidity for RANK-L. Such multivalent constructs will be clear to the skilled person based on the disclosure herein; some preferred, but non-limiting examples of such multivalent NANOBODY constructs are the constructs of SEQ ID NO's: 622-693, 761-762 and 766-773 (bivalent) and SEQ ID NO's: 694-729 and 759-760 (trivalent).

According to another specific, but non-limiting aspect, a polypeptide of the invention comprises or essentially consists of at least one NANOBODY of the invention and at least one other binding unit (i.e. directed against another epitope, antigen, target, protein or polypeptide), which is preferably also a NANOBODY. Such proteins or polypeptides are also referred to herein as "multispecific" proteins or polypeptides or as 'multispecific constructs", and these may provide certain advantages compared to the corresponding monovalent NANOBODIES of the invention (as will become clear from the further discussion herein of some preferred, but-nonlimiting multispecific constructs). Such multispecific constructs will be clear to the skilled person based on the disclosure herein; some preferred, but non-limiting examples of such multispecific NANOBODY constructs are the constructs of SEQ ID NO's: 694-729 and 759-790.

According to yet another specific, but non-limiting aspect, a polypeptide of the invention comprises or essentially consists of at least one NANOBODY of the invention, optionally one or more further NANOBODIES, and at least one other amino acid sequence (such as a protein or polypeptide) that confers at least one desired property to the NANOBODY of the invention and/or to the resulting fusion protein. Again, such fusion proteins may provide certain advantages compared to the corresponding monovalent NANOBODIES of the invention. Some non-limiting examples of such amino acid sequences and of such fusion constructs will become clear from the further description herein.

It is also possible to combine two or more of the above aspects, for example to provide a trivalent bispecific construct comprising two NANOBODIES of the invention and one other NANOBODY, and optionally one or more other amino acid sequences. Further non-limiting examples of such constructs, as well as some constructs that are particularly preferred within the context of the present invention, will become clear from the further description herein.

In the above constructs, the one or more NANOBODIES and/or other amino acid sequences may be directly linked to each other and/or suitably linked to each other via one or more linker sequences. Some suitable but non-limiting examples of such linkers will become clear from the further description herein.

In one specific aspect of the invention, a NANOBODY of the invention or a compound, construct or polypeptide of the invention comprising at least one NANOBODY of the invention may have an increased half-life, compared to the corresponding amino acid sequence of the invention. Some preferred, but non-limiting examples of such NANOBODIES, compounds and polypeptides will become clear to the skilled person based on the further disclosure herein, and for example comprise NANOBODIES sequences or polypeptides of the invention that have been chemically modified to increase the half-life thereof (for example, by means of pegylation); amino acid sequences of the invention that comprise at least one additional binding site for binding to a serum protein (such as serum albumin); or polypeptides of the invention that comprise at least one NANOBODY of the invention that is linked to at least one moiety (and in particular at least one amino acid sequence) that increases the half-life of the NANOBODY of the invention. Examples of polypeptides of the invention that comprise such half-life extending moieties or amino acid sequences will become clear to the skilled person based on the further disclosure herein; and for example include, without limitation, polypeptides in which the one or more NANOBODIES of the invention are suitable linked to one or more serum proteins or fragments thereof (such as serum albumin or suitable fragments thereof) or to one or more binding units that can bind to serum proteins (such as, for example, NANOBODIES or (single) domain antibodies that can bind to serum proteins such as serum albumin, serum immunoglobulins such as IgG, or transferrin); polypeptides in which a NANOBODY of the invention is linked to an Fc portion (such as a human Fc) or a suitable part or fragment thereof (the invention, for examples envisages polypeptides in which the NANOBODIES are suitably linked to an Fc portion by linkers in different sizes to allow intra and/or intermolecular binding of RANK-L); or polypeptides in which the one or more NANOBODIES of the invention are suitable linked to one or more small proteins or peptides that can bind to serum proteins (such as, without limitation, the proteins and peptides described in WO 91/01743, WO 01/45746, WO 02/076489 and to the US provisional application of Ablynx N.V. entitled "Peptides capable of binding to serum proteins" of Ablynx N.V. filed on Dec. 5, 2006 (see also PCT/EP2007/063348).

Again, as will be clear to the skilled person, such NANOBODIES, compounds, constructs or polypeptides may contain one or more additional groups, residues, moieties or binding units, such as one or more further amino acid sequences and in particular one or more additional NANOBODIES (i.e. not directed against RANK-L), so as to provide a tri- of multispecific NANOBODY construct.

Generally, the NANOBODIES of the invention (or compounds, constructs or polypeptides comprising the same) with increased half-life preferably have a half-life that is at least 1.5 times, preferably at least 2 times, such as at least 5 times, for example at least 10 times or more than 20 times, greater than the half-life of the corresponding amino acid sequence of the invention per se. For example, the NANOBODIES, compounds, constructs or polypeptides of the invention with increased half-life may have a half-life that is increased with more than 1 hours, preferably more than 2 hours, more preferably more than 6 hours, such as more than 12 hours, or even more than 24, 48 or 72 hours, compared to the corresponding amino acid sequence of the invention per se.

In a preferred, but non-limiting aspect of the invention, such NANOBODIES, compound, constructs or polypeptides of the invention exhibit a serum half-life in human of at least about 12 hours, preferably at least 24 hours, more preferably at least 48 hours, even more preferably at least 72 hours or more. For example, compounds or polypeptides of the invention may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

In another one aspect of the invention, a polypeptide of the invention comprises one or more (such as two or preferably one) NANOBODIES of the invention linked (optionally via one or more suitable linker sequences) to one or more (such as two and preferably one) amino acid sequences that allow the resulting polypeptide of the invention to cross the blood brain barrier. In particular, said one or more amino acid sequences that allow the resulting polypeptides of the invention to cross the blood brain barrier may be one or more (such as two and preferably one) NANOBODIES, such as the NANOBODIES described in WO 02/057445, of which FC44 (SEQ ID NO: 189 of WO 06/040153) and FC5 (SEQ ID NO: 190 of WO 06/040154) are preferred examples.

In particular, polypeptides comprising one or more NANOBODIES of the invention are preferably such that they:

bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to RANK-L with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to RANK-L with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, a polypeptide that contains only one amino acid sequence of the invention is preferably such that it will bind to RANK-L with an affinity less than 500 nM, preferably less than 200 nM, more preferably less than 10 nM, such as less than 500 pM. In this respect, it will be clear to the skilled person that a polypeptide that contains two or more NANOBODIES of the invention may bind to RANK-L with an increased avidity, compared to a polypeptide that contains only one amino acid sequence of the invention.

Some preferred $IC_{50}$ values for binding of the amino acid sequences or polypeptides of the invention to RANK-L will become clear from the further description and examples herein.

Other polypeptides according to this preferred aspect of the invention may for example be chosen from the group consisting of amino acid sequences that have more than 80%, preferably more than 90%, more preferably more than 95%, such as 99% or more "sequence identity" (as defined herein) with one or more of the amino acid sequences of SEQ ID NO's: 622-729, 759-762 and 766-773, in which the NANOBODIES comprised within said amino acid sequences are preferably as further defined herein.

Another aspect of this invention relates to a nucleic acid that encodes an amino acid sequence of the invention (such as a NANOBODY of the invention) or a polypeptide of the invention comprising the same. Again, as generally described herein for the nucleic acids of the invention, such a nucleic acid may be in the form of a genetic construct, as defined herein.

In another aspect, the invention relates to host or host cell that expresses or that is capable of expressing an amino acid sequence (such as a NANOBODY) of the invention and/or a polypeptide of the invention comprising the same; and/or that contains a nucleic acid of the invention. Some preferred but non-limiting examples of such hosts or host cells will become clear from the further description herein.

Another aspect of the invention relates to a product or composition containing or comprising at least one amino acid sequence of the invention, at least one polypeptide of the invention and/or at least one nucleic acid of the invention, and optionally one or more further components of such compositions known per se, i.e. depending on the intended use of the composition. Such a product or composition may for example be a pharmaceutical composition (as described herein), a veterinary composition or a product or composition for diagnostic use (as also described herein). Some preferred but non-limiting examples of such products or compositions will become clear from the further description herein.

The invention further relates to methods for preparing or generating the amino acid sequences, compounds, constructs, polypeptides, nucleic acids, host cells, products and compositions described herein. Some preferred but non-limiting examples of such methods will become clear from the further description herein.

The invention further relates to applications and uses of the amino acid sequences, compounds, constructs, polypeptides, nucleic acids, host cells, products and compositions described herein, as well as to methods for the prevention and/or treatment for diseases and disorders associated with RANK-L. Some preferred but non-limiting applications and uses will become clear from the further description herein.

Other aspects, embodiments, advantages and applications of the invention will also become clear from the further description hereinbelow.

Generally, it should be noted that the term NANOBODY as used herein in its broadest sense is not limited to a specific biological source or to a specific method of preparation. For example, as will be discussed in more detail below, the NANOBODIES of the invention can generally be obtained: (1) by isolating the $V_{HH}$ domain of a naturally occurring heavy chain antibody; (2) by expression of a nucleotide sequence encoding a naturally occurring $V_{HH}$ domain; (3) by "humanization" (as described herein) of a naturally occurring $V_{HH}$ domain or by expression of a nucleic acid encoding a such humanized $V_{HH}$ domain; (4) by "camelization" (as described herein) of a naturally occurring $V_H$ domain from any animal species, and in particular a from species of mammal, such as from a human being, or by expression of a nucleic acid encoding such a camelized $V_H$ domain; (5) by "camelization" of a "domain antibody" or "Dab" as described by Ward et al (supra), or by expression of a nucleic acid encoding such a camelized $V_H$ domain; (6) by using synthetic or semi-synthetic techniques for preparing proteins, polypeptides or other amino acid sequences known per se; (7) by preparing a nucleic acid encoding a NANOBODY using techniques for nucleic acid synthesis known per se, followed by expression of the nucleic acid thus obtained; and/or (8) by any combination of one or more of the foregoing. Suitable methods and techniques for performing the foregoing will be clear to the skilled person based on the disclosure herein and for example include the methods and techniques described in more detail herein.

One preferred class of NANOBODIES corresponds to the $V_{HH}$ domains of naturally occurring heavy chain antibodies directed against RANK-L. As further described herein, such $V_{HH}$ sequences can generally be generated or obtained by suitably immunizing a species of Camelid with RANK-L (i.e. so as to raise an immune response and/or heavy chain antibodies directed against RANK-L), by obtaining a suitable biological sample from said Camelid (such as a blood sample, serum sample or sample of B-cells), and by generating $V_{HH}$ sequences directed against RANK-L, starting from said sample, using any suitable technique known per se. Such techniques will be clear to the skilled person and/or are further described herein.

Alternatively, such naturally occurring $V_{HH}$ domains against RANK-L, can be obtained from naïve libraries of Camelid $V_{HH}$ sequences, for example by screening such a library using RANK-L, or at least one part, fragment, antigenic determinant or epitope thereof using one or more screening techniques known per se. Such libraries and techniques are for example described in WO 99/37681, WO 01/90190, WO 03/025020 and WO 03/035694. Alternatively, improved synthetic or semi-synthetic libraries derived from naïve $V_{HH}$ libraries may be used, such as $V_{HH}$ libraries obtained from naïve $V_{HH}$ libraries by techniques such as random mutagenesis and/or CDR shuffling, as for example described in WO 00/43507.

Thus, in another aspect, the invention relates to a method for generating NANOBODIES, that are directed against RANK-L. In one aspect, said method at least comprises the steps of:

a) providing a set, collection or library of NANOBODY sequences; and b) screening said set, collection or library of NANOBODY sequences for NANOBODY sequences that can bind to and/or have affinity for RANK-L;

and c) isolating the amino acid sequence(s) that can bind to and/or have affinity for RANK-L.

In such a method, the set, collection or library of NANOBODY sequences may be a naïve set, collection or library of NANOBODY sequences; a synthetic or semi-synthetic set, collection or library of NANOBODY sequences; and/or a set, collection or library of NANOBODY sequences that have been subjected to affinity maturation.

In a preferred aspect of this method, the set, collection or library of NANOBODY sequences may be an immune set, collection or library of NANOBODY sequences, and in particular an immune set, collection or library of $V_{HH}$ sequences, that have been derived from a species of Camelid that has been suitably immunized with RANK-L or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of NANOBODY or $V_{HH}$ sequences may be displayed on a phage, phagemid, ribosome or suitable micro-organism (such as yeast), such as to facilitate screening. Suitable methods, techniques and host organisms for displaying and screening (a set, collection or library of) NANOBODY sequences will be clear to the person skilled in the art, for example on the basis of the further disclosure herein. Reference is also made to WO 03/054016 and to the review by Hoogenboom in Nature Biotechnology, 23, 9, 1105-1116 (2005).

In another aspect, the method for generating NANOBODY sequences comprises at least the steps of:
a) providing a collection or sample of cells derived from a species of Camelid that express immunoglobulin sequences;
b) screening said collection or sample of cells for (i) cells that express an immunoglobulin sequence that can bind to and/or have affinity for RANK-L; and (ii) cells that express heavy chain antibodies, in which substeps (i) and (ii) can be performed essentially as a single screening step or in any suitable order as two separate screening steps, so as to provide at least one cell that expresses a heavy chain antibody that can bind to and/or has affinity for RANK-L; and
c) either (i) isolating from said cell the $V_{HH}$ sequence present in said heavy chain antibody; or (ii) isolating from said cell a nucleic acid sequence that encodes the $V_{HH}$ sequence present in said heavy chain antibody, followed by expressing said $V_{HH}$ domain.

In the method according to this aspect, the collection or sample of cells may for example be a collection or sample of B-cells. Also, in this method, the sample of cells may be derived from a Camelid that has been suitably immunized with RANK-L or a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

The above method may be performed in any suitable manner, as will be clear to the skilled person. Reference is for example made to EP 0 542 810, WO 05/19824, WO 04/051268 and WO 04/106377. The screening of step b) is preferably performed using a flow cytometry technique such as FACS. For this, reference is for example made to Lieby et al., Blood, Vol. 97, No. 12, 3820. Particular reference is made to the so-called "Nanoclone™" technique described in International application WO 06/079372 by Ablynx N.V.

In another aspect, the method for generating an amino acid sequence directed against RANK-L may comprise at least the steps of:
a) providing a set, collection or library of nucleic acid sequences encoding heavy chain antibodies or NANOBODY sequences;
b) screening said set, collection or library of nucleic acid sequences for nucleic acid sequences that encode a heavy chain antibody or a NANOBODY sequence that can bind to and/or has affinity for RANK-L; and
c) isolating said nucleic acid sequence, followed by expressing the $V_{HH}$ sequence present in said heavy chain antibody or by expressing said NANOBODY sequence, respectively.

In such a method, the set, collection or library of nucleic acid sequences encoding heavy chain antibodies or NANOBODY sequences may for example be a set, collection or library of nucleic acid sequences encoding a naïve set, collection or library of heavy chain antibodies or $V_{HH}$ sequences; a set, collection or library of nucleic acid sequences encoding a synthetic or semi-synthetic set, collection or library of NANOBODY sequences; and/or a set, collection or library of nucleic acid sequences encoding a set, collection or library of NANOBODY sequences that have been subjected to affinity maturation.

In a preferred aspect of this method, the set, collection or library of amino acid sequences may be an immune set, collection or library of nucleic acid sequences encoding heavy chain antibodies or $V_{HH}$ sequences derived from a Camelid that has been suitably immunized with RANK-L or with a suitable antigenic determinant based thereon or derived therefrom, such as an antigenic part, fragment, region, domain, loop or other epitope thereof. In one particular aspect, said antigenic determinant may be an extracellular part, region, domain, loop or other extracellular epitope(s).

In the above methods, the set, collection or library of nucleotide sequences may be displayed on a phage, phagemid, ribosome or suitable micro-organism (such as yeast), such as to facilitate screening. Suitable methods, techniques and host organisms for displaying and screening (a set, collection or library of) nucleotide sequences encoding amino acid sequences will be clear to the person skilled in the art, for example on the basis of the further disclosure herein. Reference is also made to WO 03/054016 and to the review by Hoogenboom in Nature Biotechnology, 23, 9, 1105-1116 (2005).

As will be clear to the skilled person, the screening step of the methods described herein can also be performed as a selection step. Accordingly the term "screening" as used in the present description can comprise selection, screening or any suitable combination of selection and/or screening techniques. Also, when a set, collection or library of sequences is used, it may contain any suitable number of sequences, such as 1, 2, 3 or about 5, 10, 50, 100, 500, 1000, 5000, $10^4$, $10^5$, $10^6$, $10^7$, $10^8$ or more sequences.

Also, one or more or all of the sequences in the above set, collection or library of amino acid sequences may be obtained or defined by rational, or semi-empirical approaches such as computer modelling techniques or biostatics or datamining techniques.

Furthermore, such a set, collection or library can comprise one, two or more sequences that are variants from one another (e.g. with designed point mutations or with randomized positions), compromise multiple sequences derived from a diverse set of naturally diversified sequences (e.g. an immune library)), or any other source of diverse sequences (as described for example in Hoogenboom et al, Nat Biotechnol 23:1105, 2005 and Binz et al, Nat Biotechnol 2005, 23:1247). Such set, collection or library of sequences can be displayed on the surface of a phage particle, a ribosome, a bacterium, a yeast cell, a mammalian cell, and linked to the nucleotide sequence encoding the amino acid sequence within these carriers. This makes such set, collection or library amenable to selection procedures to isolate the desired amino acid sequences of the invention. More generally, when a sequence is displayed on a suitable host or host cell, it is also possible (and customary) to first isolate from said host or host cell a nucleotide sequence that encodes the desired sequence, and then to obtain the desired sequence by suitably expressing said nucleotide sequence in a suitable host organism. Again, this can be performed in any suitable manner known per se, as will be clear to the skilled person.

Yet another technique for obtaining $V_{HH}$ sequences or NANOBODY sequences directed against RANK-L involves suitably immunizing a transgenic mammal that is capable of expressing heavy chain antibodies (i.e. so as to raise an immune response and/or heavy chain antibodies directed against RANK-L), obtaining a suitable biological sample from said transgenic mammal that contains (nucleic acid sequences encoding) said $V_{HH}$ sequences or NANOBODY sequences (such as a blood sample, serum sample or sample of B-cells), and then generating $V_{HH}$ sequences directed against RANK-L, starting from said sample, using any suitable technique known per se (such as any of the methods described herein or a hybridoma technique). For example, for this purpose, the heavy chain antibody-expressing mice and the further methods and techniques described in WO 02/085945, WO 04/049794 and WO 06/008548 and Janssens et al., Proc. Natl. Acad. Sci. USA. 2006 Oct. 10; 103(41):15130-5 can be used. For example, such heavy chain antibody expressing mice can express heavy chain antibodies with any suitable (single) variable domain, such as (single) variable domains from natural sources (e.g. human (single) variable domains, Camelid (single) variable domains or shark (single) variable domains), as well as for example synthetic or semi-synthetic (single) variable domains.

The invention also relates to the $V_{HH}$ sequences or NANOBODY sequences that are obtained by the above methods, or alternatively by a method that comprises the one of the above methods and in addition at least the steps of determining the nucleotide sequence or amino acid sequence of said $V_{HH}$ sequence or NANOBODY sequence; and of expressing or synthesizing said $V_{HH}$ sequence or NANOBODY sequence in a manner known per se, such as by expression in a suitable host cell or host organism or by chemical synthesis.

As mentioned herein, a particularly preferred class of NANOBODIES of the invention comprises NANOBODIES with an amino acid sequence that corresponds to the amino acid sequence of a naturally occurring $V_{HH}$ domain, but that has been "humanized", i.e. by replacing one or more amino acid residues in the amino acid sequence of said naturally occurring $V_{HH}$ sequence (and in particular in the framework sequences) by one or more of the amino acid residues that occur at the corresponding position(s) in a $V_H$ domain from a conventional 4-chain antibody from a human being (e.g. indicated above). This can be performed in a manner known per se, which will be clear to the skilled person, for example on the basis of the further description herein and the prior art on humanization referred to herein. Again, it should be noted that such humanized NANOBODIES of the invention can be obtained in any suitable manner known per se (i.e. as indicated under points (1)-(8) above) and thus are not strictly limited to polypeptides that have been obtained using a polypeptide that comprises a naturally occurring $V_{HH}$ domain as a starting material.

Another particularly preferred class of NANOBODIES of the invention comprises NANOBODIES with an amino acid sequence that corresponds to the amino acid sequence of a naturally occurring $V_H$ domain, but that has been "camelized", i.e. by replacing one or more amino acid residues in the amino acid sequence of a naturally occurring $V_H$ domain from a conventional 4-chain antibody by one or more of the amino acid residues that occur at the corresponding position(s) in a $V_{HH}$ domain of a heavy chain antibody. This can be performed in a manner known per se, which will be clear to the skilled person, for example on the basis of the further description herein. Such "camelizing" substitutions are preferably inserted at amino acid positions that form and/or are present at the $V_H$-$V_L$ interface, and/or at the so-called Camelidae hallmark residues, as defined herein (see for example WO 94/04678 and Davies and Riechmann (1994 and 1996), supra). Preferably, the $V_H$ sequence that is used as a starting material or starting point for generating or designing the camelized NANOBODY is preferably a $V_H$ sequence from a mammal, more preferably the $V_H$ sequence of a human being, such as a $V_H3$ sequence. However, it should be noted that such camelized NANOBODIES of the invention can be obtained in any suitable manner known per se (i.e. as indicated under points (1)-(8) above) and thus are not strictly limited to polypeptides that have been obtained using a polypeptide that comprises a naturally occurring $V_H$ domain as a starting material.

For example, again as further described herein, both "humanization" and "camelization" can be performed by providing a nucleotide sequence that encodes a naturally occurring $V_{HH}$ domain or $V_H$ domain, respectively, and then changing, in a manner known per se, one or more codons in said nucleotide sequence in such a way that the new nucleotide sequence encodes a "humanized" or "camelized" NANOBODY of the invention, respectively. This nucleic acid can then be expressed in a manner known per se, so as to provide the desired NANOBODY of the invention. Alternatively, based on the amino acid sequence of a naturally occurring $V_{HH}$ domain or $V_H$ domain, respectively, the amino acid sequence of the desired humanized or camelized NANOBODY of the invention, respectively, can be designed and then synthesized de novo using techniques for peptide synthesis known per se. Also, based on the amino acid sequence or nucleotide sequence of a naturally occurring $V_{HH}$ domain or $V_H$ domain, respectively, a nucleotide sequence encoding the desired humanized or camelized NANOBODY of the invention, respectively, can be designed and then synthesized de novo using techniques for nucleic acid synthesis known per se, after which the nucleic acid thus obtained can be expressed in a manner known per se, so as to provide the desired NANOBODY of the invention.

Other suitable methods and techniques for obtaining the NANOBODIES of the invention and/or nucleic acids encoding the same, starting from naturally occurring $V_H$ sequences or preferably $V_{HH}$ sequences, will be clear from the skilled person, and may for example comprise combining one or more parts of one or more naturally occurring $V_H$ sequences (such as one or more FR sequences and/or CDR sequences), one or more parts of one or more naturally occurring $V_{HH}$ sequences (such as one or more FR sequences or CDR sequences), and/or one or more synthetic or semi-synthetic sequences, in a suitable manner, so as to provide a NANOBODY of the invention or a nucleotide sequence or nucleic acid encoding the same (which may then be suitably expressed). Nucleotide sequences encoding framework sequences of $V_{HH}$ sequences or NANOBODIES will be clear to the skilled person based on the disclosure herein and/or the further prior art cited herein (and/or may alternatively be obtained by PCR starting from the nucleotide sequences obtained using the methods described herein) and may be suitably combined with nucleotide sequences that encode the desired CDR's (for example, by PCR assembly using overlapping primers), so as to provide a nucleic acid encoding a NANOBODY of the invention.

As mentioned herein, NANOBODIES may in particular be characterized by the presence of one or more "Hallmark residues" (as described herein) in one or more of the framework sequences.

Thus, according to one preferred, but non-limiting aspect of the invention, a NANOBODY in its broadest sense can be generally defined as a polypeptide comprising:

a) an amino acid sequence that is comprised of four framework regions/sequences interrupted by three complementarity determining regions/sequences, in which the amino acid residue at position 108 according to the Kabat numbering is Q;

and/or:

b) an amino acid sequence that is comprised of four framework regions/sequences interrupted by three complementarity determining regions/sequences, in which the amino acid residue at position 45 according to the Kabat numbering is a charged amino acid (as defined herein) or a cysteine residue, and position 44 is preferably an E;

and/or:

c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, in a first preferred, but non-limiting aspect, a NANOBODY of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q; and/or in which:

b) the amino acid residue at position 45 according to the Kabat numbering is a charged amino acid or a cysteine and the amino acid residue at position 44 according to the Kabat numbering is preferably E;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, a NANOBODY in its broadest sense can be generally defined as a polypeptide comprising:

a) an amino acid sequence that is comprised of four framework regions/sequences interrupted by three complementarity determining regions/sequences, in which the amino acid residue at position 108 according to the Kabat numbering is Q;

and/or:

b) an amino acid sequence that is comprised of four framework regions/sequences interrupted by three complementarity determining regions/sequences, in which the amino acid residue at position 44 according to the Kabat numbering is E and in which the amino acid residue at position 45 according to the Kabat numbering is an R;

and/or:

c) an amino acid sequence that is comprised of four framework regions/sequences interrupted by three complementarity determining regions/sequences, in which the amino acid residue at position 103 according to the Kabat numbering is chosen from the group consisting of P, R and S, and is in particular chosen from the group consisting of R and S.

Thus, according to a preferred, but non-limiting aspect, a NANOBODY of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:

b) the amino acid residue at position 44 according to the Kabat numbering is E and in which the amino acid residue at position 45 according to the Kabat numbering is an R;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, a NANOBODY against RANK-L according to the invention may have the structure:
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which a) the amino acid residue at position 108 according to the Kabat numbering is Q;

and/or in which:

b) the amino acid residue at position 44 according to the Kabat numbering is E and in which the amino acid residue at position 45 according to the Kabat numbering is an R;

and/or in which:

c) the amino acid residue at position 103 according to the Kabat numbering is chosen from the group consisting of P, R and S, and is in particular chosen from the group consisting of R and S;

and in which:

d) CDR1, CDR2 and CDR3 are as defined herein, and are preferably as defined according to one of the preferred aspects herein, and are more preferably as defined according to one of the more preferred aspects herein.

In particular, according to one preferred, but non-limiting aspect of the invention, a NANOBODY can generally be defined as a polypeptide comprising an amino acid sequence that is comprised of four framework regions/sequences interrupted by three complementarity determining regions/sequences, in which;

a-1) the amino acid residue at position 44 according to the Kabat numbering is chosen from the group consisting of A, G, E, D, G, Q, R, S, L; and is preferably chosen from the group consisting of G, E or Q; and a-2) the amino acid residue at position 45 according to the Kabat numbering is chosen from the group consisting of L, R or C; and is preferably chosen from the group consisting of L or R; and a-3) the amino acid residue at position 103 according to the Kabat numbering is chosen from the group consisting of W, R or S; and is preferably W or R, and is most preferably W;

a-4) the amino acid residue at position 108 according to the Kabat numbering is Q; or in which:

b-1) the amino acid residue at position 44 according to the Kabat numbering is chosen from the group consisting of E and Q; and b-2) the amino acid residue at position 45 according to the Kabat numbering is R; and
b-3) the amino acid residue at position 103 according to the Kabat numbering is chosen from the group consisting of W, R and S; and is preferably W;
b-4) the amino acid residue at position 108 according to the Kabat numbering is chosen from the group consisting of Q and L; and is preferably Q;
or in which:
c-1) the amino acid residue at position 44 according to the Kabat numbering is chosen from the group consisting of A, G, E, D, Q, R, S and L; and is preferably chosen from the group consisting of G, E and Q; and
c-2) the amino acid residue at position 45 according to the Kabat numbering is chosen from the group consisting of L, R and C; and is preferably chosen from the group consisting of L and R; and
c-3) the amino acid residue at position 103 according to the Kabat numbering is chosen from the group consisting of P, R and S; and is in particular chosen from the group consisting of R and S; and
c-4) the amino acid residue at position 108 according to the Kabat numbering is chosen from the group consisting of Q and L; is preferably Q;
and in which
d) CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a NANOBODY of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which:
a-1) the amino acid residue at position 44 according to the Kabat numbering is chosen from the group consisting of A, G, E, D, G, Q, R, S, L; and is preferably chosen from the group consisting of G, E or Q;
and in which:
a-2) the amino acid residue at position 45 according to the Kabat numbering is chosen from the group consisting of L, R or C; and is preferably chosen from the group consisting of L or R;
and in which:
a-3) the amino acid residue at position 103 according to the Kabat numbering is chosen from the group consisting of W, R or S; and is preferably W or R, and is most preferably W;
and in which
a-4) the amino acid residue at position 108 according to the Kabat numbering is Q;
and in which:
d) CDR1, CDR2 and CDR3 are as defined herein, and are preferably as defined according to one of the preferred aspects herein, and are more preferably as defined according to one of the more preferred aspects herein.

In another preferred, but non-limiting aspect, a NANOBODY of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which:
b-1) the amino acid residue at position 44 according to the Kabat numbering is chosen from the group consisting of E and Q;
and in which:
b-2) the amino acid residue at position 45 according to the Kabat numbering is R;
and in which:
b-3) the amino acid residue at position 103 according to the Kabat numbering is chosen from the group consisting of W, R and S; and is preferably W;
and in which:
b-4) the amino acid residue at position 108 according to the Kabat numbering is chosen from the group consisting of Q and L; and is preferably Q;
and in which:
d) CDR1, CDR2 and CDR3 are as defined herein, and are preferably as defined according to one of the preferred aspects herein, and are more preferably as defined according to one of the more preferred aspects herein.

In another preferred, but non-limiting aspect, a NANOBODY of the invention may have the structure
FR1-CDR1-FR2-CDR2-FR3-CDR3-FR4
in which FR1 to FR4 refer to framework regions 1 to 4, respectively, and in which CDR1 to CDR3 refer to the complementarity determining regions 1 to 3, respectively, and in which:
c-1) the amino acid residue at position 44 according to the Kabat numbering is chosen from the group consisting of A, G, E, D, Q, R, S and L; and is preferably chosen from the group consisting of G, E and Q;
and in which:
c-2) the amino acid residue at position 45 according to the Kabat numbering is chosen from the group consisting of L, R and C; and is preferably chosen from the group consisting of L and R;
and in which:
c-3) the amino acid residue at position 103 according to the Kabat numbering is chosen from the group consisting of P, R and S; and is in particular chosen from the group consisting of R and S;
and in which:
c-4) the amino acid residue at position 108 according to the Kabat numbering is chosen from the group consisting of Q and L; is preferably Q;
and in which:
d) CDR1, CDR2 and CDR3 are as defined herein, and are preferably as defined according to one of the preferred aspects herein, and are more preferably as defined according to one of the more preferred aspects herein.

Two particularly preferred, but non-limiting groups of the NANOBODIES of the invention are those according to a) above; according to (a-1) to (a-4) above; according to b) above; according to (b-1) to (b-4) above; according to (c) above; and/or according to (c-1) to (c-4) above, in which either:
i) the amino acid residues at positions 44-47 according to the Kabat numbering form the sequence GLEW (SEQ ID NO: 817) (or a GLEW-like sequence as described herein) and the amino acid residue at position 108 is Q;
or in which:
ii) the amino acid residues at positions 43-46 according to the Kabat numbering form the sequence KERE (SEQ ID NO: 818) or KQRE (SEQ ID NO: 819) (or a KERE-like sequence as described) and the amino acid residue at position 108 is Q or L, and is preferably Q.

Thus, in another preferred, but non-limiting aspect, a NANOBODY of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) the amino acid residues at positions 44-47 according to the Kabat numbering form the sequence GLEW (SEQ ID NO: 817) (or a GLEW-like sequence as defined herein) and the amino acid residue at position 108 is Q;

and in which:

ii) CDR1, CDR2 and CDR3 are as defined herein, and are preferably as defined according to one of the preferred aspects herein, and are more preferably as defined according to one of the more preferred aspects herein.

In another preferred, but non-limiting aspect, a NANOBODY of the invention may have the structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) the amino acid residues at positions 43-46 according to the Kabat numbering form the sequence KERE (SEQ ID NO: 818) or KQRE (SEQ ID NO: 819) (or a KERE-like sequence) and the amino acid residue at position 108 is Q or L, and is preferably Q;

and in which:

ii) CDR1, CDR2 and CDR3 are as defined herein, and are preferably as defined according to one of the preferred aspects herein, and are more preferably as defined according to one of the more preferred aspects herein.

In the NANOBODIES of the invention in which the amino acid residues at positions 43-46 according to the Kabat numbering form the sequence KERE (SEQ ID NO: 818) or KQRE (SEQ ID NO: 819), the amino acid residue at position 37 is most preferably F. In the NANOBODIES of the invention in which the amino acid residues at positions 44-47 according to the Kabat numbering form the sequence GLEW (SEQ ID NO: 817), the amino acid residue at position 37 is chosen from the group consisting of Y, H, I, L, V or F, and is most preferably V.

Thus, without being limited hereto in any way, on the basis of the amino acid residues present on the positions mentioned above, the NANOBODIES of the invention can generally be classified on the basis of the following three groups:

i) The "GLEW-group": NANOBODIES with the amino acid sequence GLEW (SEQ ID NO: 817) at positions 44-47 according to the Kabat numbering and Q at position 108 according to the Kabat numbering. As further described herein, NANOBODIES within this group usually have a V at position 37, and can have a W, P, R or S at position 103, and preferably have a W at position 103. The GLEW-group also comprises some GLEW-like sequences such as those mentioned in Table A-3 below. More generally, and without limitation, NANOBODIES belonging to the GLEW-group can be defined as NANOBODIES with a G at position 44 and/or with a W at position 47, in which position 46 is usually E and in which preferably position 45 is not a charged amino acid residue and not cysteine;

i) The "KERE-group": NANOBODIES with the amino acid sequence KERE (SEQ ID NO: 818) or KQRE (SEQ ID NO: 819) (or another KERE-like sequence) at positions 43-46 according to the Kabat numbering and Q or L at position 108 according to the Kabat numbering. As further described herein, NANOBODIES within this group usually have a F at position 37, an L or F at position 47; and can have a W, P, R or S at position 103, and preferably have a W at position 103. More generally, and without limitation, NANOBODIES belonging to the KERE-group can be defined as NANOBODIES with a K, Q or R at position 44 (usually K) in which position 45 is a charged amino acid residue or cysteine, and position 47 is as further defined herein;

iii) The "103 P, R, S-group": NANOBODIES with a P, R or S at position 103. These NANOBODIES can have either the amino acid sequence GLEW (SEQ ID NO: 817) at positions 44-47 according to the Kabat numbering or the amino acid sequence KERE (SEQ ID NO: 818) or KQRE (SEQ ID NO: 819) at positions 43-46 according to the Kabat numbering, the latter most preferably in combination with an F at position 37 and an L or an F at position 47 (as defined for the KERE-group); and can have Q or L at position 108 according to the Kabat numbering, and preferably have Q.

Also, where appropriate, NANOBODIES may belong to (i.e. have characteristics of) two or more of these classes. For example, one specifically preferred group of NANOBODIES has GLEW (SEQ ID NO: 817) or a GLEW-like sequence at positions 44-47; P, R or S (and in particular R) at position 103; and Q at position 108 (which may be humanized to L).

More generally, it should be noted that the definitions referred to above describe and apply to NANOBODIES in the form of a native (i.e. non-humanized) $V_{HH}$ sequence, and that humanized variants of these NANOBODIES may contain other amino acid residues than those indicated above (i.e. one or more humanizing substitutions as defined herein). For example, and without limitation, in some humanized NANOBODIES of the GLEW-group or the 103 P, R, S-group, Q at position 108 may be humanized to 108L. As already mentioned herein, other humanizing substitutions (and suitable combinations thereof) will become clear to the skilled person based on the disclosure herein. In addition, or alternatively, other potentially useful humanizing substitutions can be ascertained by comparing the sequence of the framework regions of a naturally occurring $V_{HH}$ sequence with the corresponding framework sequence of one or more closely related human $V_H$ sequences, after which one or more of the potentially useful humanizing substitutions (or combinations thereof) thus determined can be introduced into said $V_{HH}$ sequence (in any manner known per se, as further described herein) and the resulting humanized $V_{HH}$ sequences can be tested for affinity for the target, for stability, for ease and level of expression, and/or for other desired properties. In this way, by means of a limited degree of trial and error, other suitable humanizing substitutions (or suitable combinations thereof) can be determined by the skilled person based on the disclosure herein. Also, based on the foregoing, (the framework regions of) a NANOBODY may be partially humanized or fully humanized.

Thus, in another preferred, but non-limiting aspect, a NANOBODY of the invention may be a NANOBODY belonging to the GLEW-group (as defined herein), and in which CDR1, CDR2 and CDR3 are as defined herein, and are preferably as defined according to one of the preferred aspects herein, and are more preferably as defined according to one of the more preferred aspects herein.

In another preferred, but non-limiting aspect, a NANOBODY of the invention may be a NANOBODY belonging to the KERE-group (as defined herein), and CDR1, CDR2 and CDR3 are as defined herein, and are preferably as defined according to one of the preferred aspects herein, and are more preferably as defined according to one of the more preferred aspects herein.

Thus, in another preferred, but non-limiting aspect, a NANOBODY of the invention may be a NANOBODY belonging to the 103 P, R, S-group (as defined herein), and in which CDR1, CDR2 and CDR3 are as defined herein, and are preferably as defined according to one of the preferred aspects herein, and are more preferably as defined according to one of the more preferred aspects herein.

Also, more generally and in addition to the 108Q, 43E/44R and 103 P, R, S residues mentioned above, the NANOBODIES of the invention can contain, at one or more positions that in a conventional $V_H$ domain would form (part of) the $V_H/V_L$ interface, one or more amino acid residues that are more highly charged than the amino acid residues that naturally occur at the same position(s) in the corresponding naturally occurring $V_H$ sequence, and in particular one or more charged amino acid residues (as mentioned in Table A-2). Such substitutions include, but are not limited to, the GLEW-like sequences mentioned in Table A-3 below; as well as the substitutions that are described in the International Application WO 00/29004 for so-called "microbodies", e.g. so as to obtain a NANOBODY with Q at position 108 in combination with KLEW (SEQ ID NO: 850) at positions 44-47. Other possible substitutions at these positions will be clear to the skilled person based upon the disclosure herein.

In one aspect of the NANOBODIES of the invention, the amino acid residue at position 83 is chosen from the group consisting of L, M, S, V and W; and is preferably L.

Also, in one aspect of the NANOBODIES of the invention, the amino acid residue at position 83 is chosen from the group consisting of R, K, N, E, G, I, T and Q; and is most preferably either K or E (for NANOBODIES corresponding to naturally occurring $V_{HH}$ domains) or R (for "humanized" NANOBODIES, as described herein). The amino acid residue at position 84 is chosen from the group consisting of P, A, R, S, D T, and V in one aspect, and is most preferably P (for NANOBODIES corresponding to naturally occurring $V_{HH}$ domains) or R (for "humanized" NANOBODIES, as described herein).

Furthermore, in one aspect of the NANOBODIES of the invention, the amino acid residue at position 104 is chosen from the group consisting of G and D; and is most preferably G.

Collectively, the amino acid residues at positions 11, 37, 44, 45, 47, 83, 84, 103, 104 and 108, which in the NANOBODIES are as mentioned above, will also be referred to herein as the "Hallmark Residues". The Hallmark Residues and the amino acid residues at the corresponding positions of the most closely related human $V_H$ domain, $V_H3$, are summarized in Table A-3.

Some especially preferred but non-limiting combinations of these Hallmark Residues as occur in naturally occurring $V_{HH}$ domains are mentioned in Table A-4. For comparison, the corresponding amino acid residues of the human $V_H3$ called DP-47 have been indicated in italics.

TABLE A-3

Hallmark Residues in NANOBODIES

| Position | Human $V_H3$ | Hallmark Residues |
|---|---|---|
| 11 | L, V; predominantly L | L, M, S, V, W; preferably L |
| 37 | V, I, F; usually V | $F^{(1)}$, Y, H, I, L or V, preferably $F^{(1)}$ or Y |
| 44[8] | G | $G^{(2)}$, $E^{(3)}$, A, D, Q, R, S, L; preferably $G^{(2)}$, $E^{(3)}$ or Q; most preferably $G^{(2)}$ or $E^{(3)}$. |
| 45[8] | L | $L^{(2)}$, $R^{(3)}$, C, I, L, P, Q, V; preferably $L^{(2)}$ or $R^{(3)}$ |
| 47[8] | W, Y | $W^{(2)}$, $L^{(1)}$ or $F^{(1)}$, A, G, I, M, R, S, V or Y; preferably $W^{(2)}$, $L^{(1)}$, $F^{(1)}$ or R |
| 83 | R or K; usually R | R, $K^{(5)}$, N, $E^{(5)}$, G, I, M, Q or T; preferably K or R; most preferably K |
| 84 | A, T, D; predominantly A | $P^{(5)}$, A, L, R, S, T, D, V; preferably P |
| 103 | W | $W^{(4)}$, $P^{(6)}$, $R^{(6)}$, S; preferably W |
| 104 | G | G or D; preferably G |
| 108 | L, M or T; predominantly L | Q, $L^{(7)}$ or R; preferably Q or $L^{(7)}$ |

Notes:
[1]In particular, but not exclusively, in combination with KERE or KQRE at positions 43-46.
[2]Usually as GLEW at positions 44-47.
[3]Usually as KERE or KQRE at positions 43-46, e.g. as KEREL, KEREF, KQREL, KQREF or KEREG at positions 43-47. Alternatively, also sequences such as TERE (for example TEREL), KECE (for example KECEL or KECER), RERE (for example REREG), QERE (for example QEREG), KGRE (for example KGREG), KDRE (for example KDREV) are possible. Some other possible, but less preferred sequences include for example DECKL and NVCEL.
[4]With both GLEW at positions 44-47 and KERE or KQRE at positions 43-46.
[5]Often as KP or EP at positions 83-84 of naturally occurring $V_{HH}$ domains.
[6]In particular, but not exclusively, in combination with GLEW at positions 44-47.
[7]With the proviso that when positions 44-47 are GLEW, position 108 is always Q in (non-humanized) $V_{HH}$ sequences that also contain a W at position 103.
The GLEW group also contains GLEW-like sequences at positions 44-47, such as for example GVEW, EPEW, GLER, DQEW, DLEW, GIEW, ELEW, GPEW, EWLP, GPER, GLER and ELEW.

TABLE A-4

Some preferred but non-limiting combinations of Hallmark Residues in naturally occurring NANOBODIES.

| | 11 | 37 | 44 | 45 | 47 | 83 | 84 | 103 | 104 | 108 |
|---|---|---|---|---|---|---|---|---|---|---|
| DP-47 (human) | M | V | G | L | W | R | A | W | G | L |
| "KERE" group | L | F | E | R | L | K | P | W | G | Q |
| | L | F | E | R | F | E | P | W | G | Q |
| | L | F | E | R | F | K | P | W | G | Q |
| | L | Y | Q | R | L | K | P | W | G | Q |
| | L | F | L | R | V | K | P | Q | G | Q |
| | L | F | Q | R | L | K | P | W | G | Q |
| | L | F | E | R | F | K | P | W | G | Q |

TABLE A-4-continued

Some preferred but non-limiting combinations of Hallmark Residues in naturally occurring NANOBODIES.

|  | 11 | 37 | 44 | 45 | 47 | 83 | 84 | 103 | 104 | 108 |
|---|---|---|---|---|---|---|---|---|---|---|
| "GLEW" group | L | V | G | L | W | K | S | W | G | Q |
|  | M | V | G | L | W | K | P | R | G | Q |

For humanization of these combinations, reference is made to the specification.

In the NANOBODIES, each amino acid residue at any other position than the Hallmark Residues can be any amino acid residue that naturally occurs at the corresponding position (according to the Kabat numbering) of a naturally occurring $V_{HH}$ domain.

Such amino acid residues will be clear to the skilled person. Tables A-5 to A-8 mention some non-limiting residues that can be present at each position (according to the Kabat numbering) of the FR1, FR2, FR3 and FR4 of naturally occurring $V_{HH}$ domains. For each position, the amino acid residue that most frequently occurs at each position of a naturally occurring $V_{HH}$ domain (and which is the most preferred amino acid residue for said position in a NANOBODY) is indicated in bold; and other preferred amino acid residues have been underlined (note: the number of amino acid residues that are found at positions 26-30 of naturally occurring $V_{HH}$ domains supports the hypothesis underlying the numbering by Chothia (supra) that the residues at these positions already form part of CDR1).

In Tables A-5-A-8, some of the non-limiting residues that can be present at each position of a human $V_H3$ domain have also been mentioned. Again, for each position, the amino acid residue that most frequently occurs at each position of a naturally occurring human $V_H3$ domain is indicated in bold; and other preferred amino acid residues have been underlined.

For reference only, Tables A-5-A-8 also contain data on the $V_{HH}$ entropy ("$V_{HH}$ Ent.") and $V_{HH}$ variability ("$V_{HH}$ Var.") at each amino acid position for a representative sample of 1118 $V_{HH}$ sequences (data kindly provided by David Lutje Hulsing and Prof. Theo Verrips of Utrecht University). The values for the $V_{HH}$ entropy and the $V_{HH}$ variability provide a measure for the variability and degree of conservation of amino acid residues between the 1118 $V_{HH}$ sequences analyzed: low values (i.e. <1, such as <0.5) indicate that an amino acid residue is highly conserved between the $V_{HH}$ sequences (i.e. little variability). For example, the G at position 8 and the G at position 9 have values for the $V_{HH}$ entropy of 0.1 and 0 respectively, indicating that these residues are highly conserved and have little variability (and in case of position 9 is G in all 1118 sequences analysed), whereas for residues that form part of the CDR's generally values of 1.5 or more are found (data not shown). Note that (1) the amino acid residues listed in the second column of Tables A-5-A-8 are based on a bigger sample than the 1118 $V_{HH}$ sequences that were analysed for determining the $V_{HH}$ entropy and $V_{HH}$ variability referred to in the last two columns; and (2) the data represented below support the hypothesis that the amino acid residues at positions 27-30 and maybe even also at positions 93 and 94 already form part of the CDR's (although the invention is not limited to any specific hypothesis or explanation, and as mentioned above, herein the numbering according to Kabat is used). For a general explanation of sequence entropy, sequence variability and the methodology for determining the same, see Oliveira et al., PROTEINS: Structure, Function and Genetics, 52: 544-552 (2003).

TABLE A-5

Non-limiting examples of amino acid residues in FR1
(for the footnotes, see the footnotes to Table A-3)

| | | Amino acid residue(s): | $V_{HH}$ | $V_{HH}$ |
|---|---|---|---|---|
| Pos. | Human $V_H3$ | Camelid $V_{HH}$'s | Ent. | Var. |
| 1 | E, Q | Q, A, E | — | — |
| 2 | V | V | 0.2 | 1 |
| 3 | Q | Q, K | 0.3 | 2 |
| 4 | L | L | 0.1 | 1 |
| 5 | V, L | Q, E, L, V | 0.8 | 3 |
| 6 | E | E, D, Q, A | 0.8 | 4 |
| 7 | S, T | S, F | 0.3 | 2 |
| 8 | G, R | G | 0.1 | 1 |
| 9 | G | G | 0 | 1 |
| 10 | G, V | G, D, R | 0.3 | 2 |
| 11 | Hallmark residue: L, M, S, V, W; preferably L | | 0.8 | 2 |
| 12 | V, I | V, A | 0.2 | 2 |
| 13 | Q, K, R | Q, E, K, P, R | 0.4 | 4 |
| 14 | P | A, Q, A, G, P, S, T, V | 1 | 5 |
| 15 | G | G | 0 | 1 |
| 16 | G, R | G, A, E, D | 0.4 | 3 |
| 17 | S | S, F | 0.5 | 2 |
| 18 | L | L, V | 0.1 | 1 |
| 19 | R, K | R, K, L, N, S, T | 0.6 | 4 |
| 20 | L | L, F, I, V | 0.5 | 4 |
| 21 | S | S, A, F, T | 0.2 | 3 |
| 22 | C | C | 0 | 1 |
| 23 | A, T | A, D, E, P, S, T, V | 1.3 | 5 |
| 24 | A | A, I, L, S, T, V | 1 | 6 |
| 25 | S | S, A, F, P, T | 0.5 | 5 |
| 26 | G | G, A, D, E, R, S, T, V | 0.7 | 7 |
| 27 | F | S, F, R, L, P, G, N, | 2.3 | 13 |
| 28 | T | N, T, E, D, S, I, R, A, G, R, F, Y | 1.7 | 11 |
| 29 | F, V | F, L, D, S, I, G, V, A | 1.9 | 11 |
| 30 | S, D, G | N, S, E, G, A, D, M, T | 1.8 | 11 |

TABLE A-6

Non-limiting examples of amino acid residues in FR2
(for the footnotes, see the footnotes to Table A-3)

| | | Amino acid residue(s): | $V_{HH}$ | $V_{HH}$ |
|---|---|---|---|---|
| Pos. | Human $V_H3$ | Camelid $V_{HH}$'s | Ent. | Var. |
| 36 | W | W | 0.1 | 1 |
| 37 | Hallmark residue: F[(1)], H, I, L, Y or V, preferably F[(1)] or Y | | 1.1 | 6 |
| 38 | R | R | 0.2 | 1 |
| 39 | Q | Q, H, P, R | 0.3 | 2 |
| 40 | A | A, F, G, L, P, T, V | 0.9 | 7 |
| 41 | P, S, T | P, A, L, S | 0.4 | 3 |
| 42 | G | G, E | 0.2 | 2 |

TABLE A-6-continued

Non-limiting examples of amino acid residues in FR2
(for the footnotes, see the footnotes to Table A-3)

| Pos. | Human $V_H3$ | Camelid $V_{HH}$'s | $V_{HH}$ Ent. | $V_{HH}$ Var. |
|---|---|---|---|---|
| 43 | K | K, D, E, N, Q, R, T, V | 0.7 | 6 |
| 44 | Hallmark residue: $G^{(2)}$, $E^{(3)}$, A, D, Q, R, S, L; preferably $G^{(2)}$, $E^{(3)}$ or Q; most preferably $G^{(2)}$ or $E^{(3)}$ | | 1.3 | 5 |
| 45 | Hallmark residue: $L^{(2)}$, $R^{(3)}$, C, I, L, P, Q, V; preferably $L^{(2)}$ or $R^{(3)}$ | | 0.6 | 4 |
| 46 | E, V | E, D, K, Q, V | 0.4 | 2 |
| 47 | Hallmark residue: $W^{(2)}$, $L^{(1)}$ or $F^{(1)}$, A, G, I, M, R, S, V or Y; preferably $W^{(2)}$, $L^{(1)}$, $F^{(1)}$ or R | | 1.9 | 9 |
| 48 | V | V, I, L | 0.4 | 3 |
| 49 | S, A, G | A, S, G, T, V | 0.8 | 3 |

TABLE A-7

Non-limiting examples of amino acid residues in FR3
(for the footnotes, see the footnotes to Table A-3)

| Pos. | Human $V_H3$ | Camelid $V_{HH}$'s | $V_{HH}$ Ent. | $V_{HH}$ Var. |
|---|---|---|---|---|
| 66 | R | R | 0.1 | 1 |
| 67 | F | F, L, V | 0.1 | 1 |
| 68 | T | T, A, N, S | 0.5 | 4 |
| 69 | I | I, L, M, V | 0.4 | 4 |
| 70 | S | S, A, F, T | 0.3 | 4 |
| 71 | R | R, G, H, I, L, K, Q, S, T, W | 1.2 | 8 |
| 72 | D, E | D, E, G, N, V | 0.5 | 4 |
| 73 | N, D, G | N, A, D, F, I, K, L, R, S, T, V, Y | 1.2 | 9 |
| 74 | A, S | A, D, G, N, P, S, T, V | 1 | 7 |
| 75 | K | K, A, E, K, L, N, Q, R | 0.9 | 6 |
| 76 | N, S | N, D, K, R, S, T, Y | 0.9 | 6 |
| 77 | S, T, I | T, A, E, I, M, P, S | 0.8 | 5 |
| 78 | L, A | V, L, A, F, G, I, M | 1.2 | 5 |
| 79 | Y, H | Y, A, D, F, H, N, S, T | 1 | 7 |
| 80 | L | L, F, V | 0.1 | 1 |
| 81 | Q | Q, E, I, L, R, T | 0.6 | 5 |
| 82 | M | M, I, L, V | 0.2 | 2 |
| 82a | N, G | N, D, G, H, S, T | 0.8 | 4 |
| 82b | S | S, N, D, G, R, T | 1 | 6 |
| 82c | L | L, P, V | 0.1 | 2 |
| 83 | Hallmark residue: R, $K^{(5)}$, N, $E^{(5)}$, G, I, M, Q or T; preferably K or R; most preferably K | | 0.9 | 7 |
| 84 | Hallmark residue: $P^{(5)}$, A, D, L, R, S, T, V; preferably P | | 0.7 | 6 |
| 85 | E, G | E, D, G, Q | 0.5 | 3 |
| 86 | D | D | 0 | 1 |
| 87 | T, M | T, A, S | 0.2 | 3 |
| 88 | A | A, G, S | 0.3 | 2 |
| 89 | V, L | V, A, D, I, L, M, N, R, T | 1.4 | 6 |
| 90 | Y | Y, F | 0 | 1 |
| 91 | Y, H | Y, D, F, H, L, S, T, V | 0.6 | 4 |
| 92 | C | C | 0 | 1 |
| 93 | A, K, T | A, N, G, H, K, N, R, S, T, V, Y | 1.4 | 10 |
| 94 | K, R, T | A, V, C, F, G, I, K, L, R, S or T | 1.6 | 9 |

TABLE A-8

Non-limiting examples of amino acid residues in FR4
(for the footnotes, see the footnotes to Table A-3)

| Pos. | Human $V_H3$ | Camelid $V_{HH}$'s | $V_{HH}$ Ent. | $V_{HH}$ Var. |
|---|---|---|---|---|
| 103 | Hallmark residue: $W^{(4)}$, $P^{(6)}$, $R^{(6)}$, S; preferably W | | 0.4 | 2 |
| 104 | Hallmark residue: G or D; preferably G | | 0.1 | 1 |
| 105 | Q, R | Q, E, K, P, R | 0.6 | 4 |
| 106 | G | G | 0.1 | 1 |
| 107 | T | T, A, I | 0.3 | 2 |
| 108 | Hallmark residue: Q, $L^{(7)}$ or R; preferably Q or $L^{(7)}$ | | 0.4 | 3 |
| 109 | V | V | 0.1 | 1 |
| 110 | T | T, I, A | 0.2 | 1 |

TABLE A-8-continued

Non-limiting examples of amino acid residues in FR4
(for the footnotes, see the footnotes to Table A-3)

| Pos. | Amino acid residue(s): Human $V_H3$ | Camelid $V_{HH}$'s | $V_{HH}$ Ent. | $V_{HH}$ Var. |
|---|---|---|---|---|
| 111 | V | V, A, I | 0.3 | 2 |
| 112 | S | S, F | 0.3 | 1 |
| 113 | S | S, A, L, P, T | 0.4 | 3 |

Thus, in another preferred, but not limiting aspect, a NANOBODY of the invention can be defined as an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) one or more of the amino acid residues at positions 11, 37, 44, 45, 47, 83, 84, 103, 104 and 108 according to the Kabat numbering are chosen from the Hallmark residues mentioned in Table A-3;

and in which:

ii) CDR1, CDR2 and CDR3 are as defined herein, and are preferably as defined according to one of the preferred aspects herein, and are more preferably as defined according to one of the more preferred aspects herein.

The above NANOBODIES may for example be $V_{HH}$ sequences or may be humanized NANOBODIES. When the above NANOBODY sequences are $V_{HH}$ sequences, they may be suitably humanized, as further described herein. When the NANOBODIES are partially humanized NANOBODIES, they may optionally be further suitably humanized, again as described herein.

In particular, a NANOBODY of the invention can be an amino acid sequence with the (general) structure

FR1-CDR1-FR2-CDR2-FR3-CDR3-FR4 in which FR1 to FR4 refer to framework regions 1 to 4, respectively, and in which CDR1 to CDR3 refer to the complementarity determining regions 1 to 3, respectively, and in which:

i) (preferably) one or more of the amino acid residues at positions 11, 37, 44, 45, 47, 83, 84, 103, 104 and 108 according to the Kabat numbering are chosen from the Hallmark residues mentioned in Table A-3 (it being understood that $V_{HH}$ sequences will contain one or more Hallmark residues; and that partially humanized NANOBODIES will usually, and preferably, [still] contain one or more Hallmark residues [although it is also within the scope of the invention to provide—where suitable in accordance with the invention—partially humanized NANOBODIES in which all Hallmark residues, but not one or more of the other amino acid residues, have been humanized]; and that in fully humanized NANOBODIES, where suitable in accordance with the invention, all amino acid residues at the positions of the Hallmark residues will be amino acid residues that occur in a human $V_H3$ sequence. As will be clear to the skilled person based on the disclosure herein that such $V_{HH}$ sequences, such partially humanized NANOBODIES with at least one Hallmark residue, such partially humanized NANOBODIES without Hallmark residues and such fully humanized NANOBODIES all form aspects of this invention);

and in which:

ii) said amino acid sequence has at least 80% amino acid identity with at least one of the amino acid sequences of SEQ ID NO's: 1 to 22, in which for the purposes of determining the degree of amino acid identity, the amino acid residues that form the CDR sequences (indicated with X in the sequences of SEQ ID NO's: 1 to 22) are disregarded;

and in which:

iii) CDR1, CDR2 and CDR3 are as defined herein, and are preferably as defined according to one of the preferred aspects herein, and are more preferably as defined according to one of the more preferred aspects herein.

The above NANOBODIES may for example be $V_{HH}$ sequences or may be humanized NANOBODIES. When the above NANOBODY sequences are $V_{HH}$ sequences, they may be suitably humanized, as further described herein. When the NANOBODIES are partially humanized NANOBODIES, they may optionally be further suitably humanized, again as described herein.

TABLE A-9

Representative amino acid sequences for NANOBODIES of the KERE, GLEW and P, R, S 103 group.
The CDR's are indicated with XXXXX

| | | |
|---|---|---|
| KERE sequence no. 1 | SEQ ID NO: 1 | EVQLVESGGGLVQPGGSLRLSCAASGIPFSXXXXXWFRQAPGKQRDSVAXXXXXRFTI SRDNAKNTVYLQMNSLKPEDTAVYRCYFXXXXXWGQGTQVTVSS |
| KERE sequence no. 2 | SEQ ID NO: 2 | QVKLEESGGGLVQAGGSLRLSCVGSGRTFSXXXXXWFRLAPGKEREFVAXXXXXRFTI SRDTASNRGYLHMNNLTPEDTAVYYCAAXXXXXWGQGTQVTVSS |
| KERE sequence no. 3 | SEQ ID NO: 3 | AVQLVDSGGGLVQAGDSLKLSCALTGGAFTXXXXXWFRQTPGREREFVAXXXXXRFTI SRDNAKNMVYLRMNSLIPEDAAVYSCAAXXXXXWGQGTLVTVSS |
| KERE sequence no. 4 | SEQ ID NO: 4 | QVQLVESGGGLVEAGGSLRLSCTASESPFRXXXXXWFRQTSGQEREFVAXXXXXRFTI SRDDAKNTVWLHGSTLKPEDTAVYYCAAXXXXXWGQGTQVTVSS |
| KERE sequence no. 5 | SEQ ID NO: 5 | AVQLVESGGGLVQGGGSLRLACAASERIFDXXXXXWYRQGPGNERELVAXXXXXRFTI SMDYTKQTVYLHMNSLRPEDTGLYYCKIXXXXXWGQGTQVTVSS |
| KERE sequence no. 6 | SEQ ID NO: 6 | DVKFVESGGGLVQAGGSLRLSCVASGFNFDXXXXXWFRQAPGKEREEVAXXXXXRFT ISSEKDKNSVYLQMNSLKPEDTALYICAGXXXXXWGRGTQVTVSS |
| KERE sequence no. 7 | SEQ ID NO: 7 | QVRLAESGGGLVQSGGSLRLSCVASGSTYTXXXXXWYRQYPGKQRALVAXXXXXRFT IARDSTKDTFCLQMNNLKPEDTAVYYCYAXXXXXWGQGTQVTVSS |
| KERE sequence no. 8 | SEQ ID NO: 8 | EVQLVESGGGLVQAGGSLRLSCAASGFTSDXXXXXWFRQAPGKPREGVSXXXXXRFT ISTDNAKNTVHLLMNRVNAEDTALYYCAVXXXXXWGRGTRVTVSS |

TABLE A-9-continued

Representative amino acid sequences for NANOBODIES of the KERE, GLEW and P, R, S 103 group. The CDR's are indicated with XXXXX

| | | |
|---|---|---|
| KERE sequence no. 9 | SEQ ID NO: 9 | QVQLVESGGGLVQPGGSLRLSCQASGDISTXXXXXWYRQVPGKLREFVAXXXXXRFTI SGDNAKRAIYLQMNNLKPDDTAVYYCNRXXXXXWGQGTQVTVSP |
| KERE sequence no. 10 | SEQ ID NO: 10 | QVPVVESGGGLVQAGDSLRLFCAVPSFTSTXXXXXWFRQAPGKEREFVAXXXXXRFTI SRNATKNTLTLRMDSLKPEDTAVYYCAAXXXXXWGQGTQVTVSS |
| KERE sequence no. 11 | SEQ ID NO: 11 | EVQLVESGGGLVQAGDSLRLFCTVSGGTASXXXXXWFRQAPGEKREFVAXXXXXRFTI ARENAGNMVYLQMNNLKPDDTALYTCAAXXXXXWGRGTQVTVSS |
| KERE sequence no. 12 | SEQ ID NO: 12 | AVQLVESGGDSVQPGDSQTLSCAASGRTNSXXXXXWFRQAPGKERVFLAXXXXXRFT ISRDSAKNMMYLQMNNLKPQDTAVYYCAAXXXXXWGQGTQVTVSS |
| KERE sequence no. 13 | SEQ ID NO: 13 | AVQLVESGGGLVQAGGSLRLSCVVSGLTSSXXXXXWFRQTPWQERDFVAXXXXXRFT ISRDNYKDTVLLEMNFLKPEDTAIYYCAAXXXXXWGQGTQVTVSS |
| KERE sequence no. 14 | SEQ ID NO: 14 | AVQLVESGGGLVQAGASLRLSCATSTRTLDXXXXXWFRQAPGRDREFVAXXXXXRFT VSRDSAENTVALQMNSLKPEDTAVYYCAAXXXXXWGQGTRVTVSS |
| KERE sequence no. 15 | SEQ ID NO: 15 | QVQLVESGGGLVQPGGSLRLSCTVSRLTAHXXXXXWFRQAPGKEREAVSXXXXXRFTI SRDYAGNTAFLQMDSLKPEDTGVYYCATXXXXXWGQGTQVTVSS |
| KERE sequence no. 16 | SEQ ID NO: 16 | EVQLVESGGELVQAGGSLKLSCTASGRNFVXXXXXWFRRAPGKEREFVAXXXXXRFT VSRDNGKNTAYLRMNSLKPEDTADYYCAVXXXXXLGSGTQVTVSS |
| GLEW sequence no. 1 | SEQ ID NO: 17 | AVQLVESGGGLVQPGGSLRLSCAASGFTFSXXXXXWVRQAPGKVLEWVSXXXXXRFT ISRDNAKNTLYLQMNSLKPEDTAVYYCVKXXXXXGSQGTQVTVSS |
| GLEW sequence no. 2 | SEQ ID NO: 18 | EVQLVESGGGLVQPGGSLRLSCVCVSSGCTXXXXXWVRQAPGKAEEWVSXXXXXRF KISRDNAKKTLYLQMNSLGPEDTAMYYCQRXXXXXRGQGTQVTVSS |
| GLEW sequence no. 3 | SEQ ID NO: 19 | EVQLVESGGGLALPGGSLTLSCVFSGSTFSXXXXXWVRHTPGKAEEWVSXXXXXRFTI SRDNAKNTLYLEMNSLSPEDTAMYYCGRXXXXXRSKGIQVTVSS |
| P, R, S 103 sequence no. 1 | SEQ ID NO: 20 | AVQLVESGGGLVQAGGSLRLSCAASGRTFSXXXXXWFRQAPGKEREFVAXXXXXRFTI SRDNAKNTVYLQMNSLKPEDTAVYYCAAXXXXXRGQGTQVTVSS |
| P, R, S 103 sequence no. 2 | SEQ ID NO: 21 | DVQLVESGGDLVQPGGSLRLSCAASGFSFDXXXXXWLRQTPGKGLEWVGXXXXXRFT ISRDNAKNMLYLHLNNLKSEDTAVYYCRRXXXXXLGQGTQVTVSS |
| P, R, S 103 sequence no. 3 | SEQ ID NO: 22 | EVQLVESGGGLVQPGGSLRLSCVCVSSGCTXXXXXWVRQAPGKAEEWVSXXXXXRF KISRDNAKKTLYLQMNSLGPEDTAMYYCQRXXXXXRGQGTQVTVSS |

In particular, a NANOBODY of the invention of the KERE group can be an amino acid sequence with the (general) structure

FR1-CDR1-FR2-CDR2-FR3-CDR3-FR4 in which:

i) the amino acid residue at position 45 according to the Kabat numbering is a charged amino acid (as defined herein) or a cysteine residue, and position 44 is preferably an E;

and in which:

ii) FR1 is an amino acid sequence that has at least 80% amino acid identity with at least one of the following amino acid sequences:

TABLE A-10

Representative FW1 sequences for NANOBODIES of the KERE-group.

| | | |
|---|---|---|
| KERE FW1 sequence no. 1 | SEQ ID NO: 23 | QVQRVESGGGLVQAGGSLRLSCAASGRTSS |
| KERE FW1 sequence no. 2 | SEQ ID NO: 24 | QVQLVESGGGLVQTGDSLSLSCSASGRTFS |
| KERE FW1 sequence no. 3 | SEQ ID NO: 25 | QVKLEESGGGLVQAGDSLRLSCAATGRAFG |
| KERE FW1 sequence no. 4 | SEQ ID NO: 26 | AVQLVESGGGLVQPGESLGLSCVASGRDFV |
| KERE FW1 sequence no. 5 | SEQ ID NO: 27 | EVQLVESGGGLVQAGGSLRLSCEVLGRTAG |
| KERE FW1 sequence no. 6 | SEQ ID NO: 28 | QVQLVESGGGWVQPGGSLRLSCAASETILS |
| KERE FW1 sequence no. 7 | SEQ ID NO: 29 | QVQLVESGGGTVQPGGSLNLSCVASGNTFN |
| KERE FW1 sequence no. 8 | SEQ ID NO: 30 | EVQLVESGGGLAQPGGSLQLSCSAPGFTLD |
| KERE FW1 sequence no. 9 | SEQ ID NO: 31 | AQELEESGGGLVQAGGSLRLSCAASGRTFN | and in which:

iii) FR2 is an amino acid sequence that has at least 80% amino acid identity with at least one of the following amino acid sequences:

TABLE A-11

Representative FW2 sequences for NANOBODIES of the KERE-group.

| KERE FW2 sequence no. 1 | SEQ ID NO: 41 | WFRQAPGKEREFVA |
|---|---|---|
| KERE FW2 sequence no. 2 | SEQ ID NO: 42 | WFRQTPGREREFVA |
| KERE FW2 sequence no. 3 | SEQ ID NO: 43 | WYRQAPGKQREMVA |
| KERE FW2 sequence no. 4 | SEQ ID NO: 44 | WYRQGPGKQRELVA |
| KERE FW2 sequence no. 5 | SEQ ID NO: 45 | WIRQAPGKEREGVS |
| KERE FW2 sequence no. 6 | SEQ ID NO: 46 | WFREAPGKEREGIS |
| KERE FW2 sequence no. 7 | SEQ ID NO: 47 | WYRQAPGKERDLVA |
| KERE FW2 sequence no. 8 | SEQ ID NO: 48 | WFRQAPGKQREEVS |
| KERE FW2 sequence no. 9 | SEQ ID NO: 49 | WFRQPPGKVREFVG | and in which:

iv) FR3 is an amino acid sequence that has at least 80% amino acid identity with at least one of the following amino acid sequences:

TABLE A-12

Representative FW3 sequences for NANOBODIES of the KERE-group.

| KERE FW3 sequence no. 1 | SEQ ID NO: 50 | RFTISRDNAKNTVYLQMNSLKPEDTAVYRCYF |
|---|---|---|
| KERE FW3 sequence no. 2 | SEQ ID NO: 51 | RFAISRDNNKNTGYLQMNSLEPEDTAVYYCAA |
| KERE FW3 sequence no. 3 | SEQ ID NO: 52 | RFTVARNNAKNTVNLEMNSLKPEDTAVYYCAA |
| KERE FW3 sequence no. 4 | SEQ ID NO: 53 | RFTISRDIAKNTVDLLMNNLEPEDTAVYYCAA |
| KERE FW3 sequence no. 5 | SEQ ID NO: 54 | RLTISRDNAVDTMYLQMNSLKPEDTAVYYCAA |
| KERE FW3 sequence no. 6 | SEQ ID NO: 55 | RFTISRDNAKNTVYLQMDNVKPEDTAIYYCAA |
| KERE FW3 sequence no. 7 | SEQ ID NO: 56 | RFTISKDSGKNTVYLQMTSLKPEDTAVYYCAT |
| KERE FW3 sequence no. 8 | SEQ ID NO: 57 | RFTISRDSAKNMMYLQMNNLKPQDTAVYYCAA |
| KERE FW3 sequence no. 9 | SEQ ID NO: 58 | RFTISRENDKSTVYLQLNSLKPEDTAVYYCAA |
| KERE FW3 sequence no. 10 | SEQ ID NO: 59 | RFTISRDYAGNTAYLQMNSLKPEDTGVYYCAT | and in which:

v) FR4 is an amino acid sequence that has at least 80% amino acid identity with at least one of the following amino acid sequences:

TABLE A-13

Representative FW4 sequences for NANOBODIES of the KERE-group.

| KERE FW4 sequence no. 1 | SEQ ID NO: 60 | WGQGTQVTVSS |
|---|---|---|
| KERE FW4 sequence no. 2 | SEQ ID NO: 61 | WGKGTLVTVSS |

TABLE A-13-continued

Representative FW4 sequences for NANOBODIES of the KERE-group.

| KERE FW4 sequence no. 3 | SEQ ID NO: 62 | RGQGTRVTVSS |
|---|---|---|
| KERE FW4 sequence no. 4 | SEQ ID NO: 63 | WGLGTQVTISS | and in which:

vi) CDR1, CDR2 and CDR3 are as defined herein, and are preferably as defined according to one of the preferred aspects herein, and are more preferably as defined according to one of the more preferred aspects herein.

In the above NANOBODIES, one or more of the further Hallmark residues are preferably as described herein (for example, when they are $V_{HH}$ sequences or partially humanized NANOBODIES).

Also, the above NANOBODIES may for example be $V_{HH}$ sequences or may be humanized NANOBODIES. When the above NANOBODY sequences are $V_{HH}$ sequences, they may be suitably humanized, as further described herein. When the NANOBODIES are partially humanized NANOBODIES, they may optionally be further suitably humanized, again as described herein.

With regard to framework 1, it will be clear to the skilled person that, when an amino acid sequence as outlined above is generated by expression of a nucleotide sequence, the first four amino acid sequences (i.e. amino acid residues 1-4 according to the Kabat numbering) may often be determined by the primer(s) that have been used to generate said nucleic acid. Thus, for determining the degree of amino acid identity, the first four amino acid residues are preferably disregarded.

Also, with regard to framework 1, and although amino acid positions 27 to 30 are according to the Kabat numbering considered to be part of the framework regions (and not the CDR's), it has been found by analysis of a database of more than 1000 $V_{HH}$ sequences that the positions 27 to 30 have a variability (expressed in terms of $V_{HH}$ entropy and $V_{HH}$ variability—see Tables A-5 to A-8) that is much greater than the variability on positions 1 to 26. Because of this, for determining the degree of amino acid identity, the amino acid residues at positions 27 to 30 are preferably also disregarded.

In view of this, a NANOBODY of the KERE class may be an amino acid sequence that is comprised of four framework regions/sequences interrupted by three complementarity determining regions/sequences, in which:
i) the amino acid residue at position 45 according to the Kabat numbering is a charged amino acid (as defined herein) or a cysteine residue, and position 44 is preferably an E;

and in which:
ii) FR1 is an amino acid sequence that, on positions 5 to 26 of the Kabat numbering, has at least 80% amino acid identity with at least one of the following amino acid sequences:

TABLE A-14

Representative FW1 sequences (amino acid residues 5 to 26) for Nanobodies of the KERE-group.

| | | |
|---|---|---|
| KERE FW1 sequence no. 10 | SEQ ID NO: 32 | VESGGGLVQPGGSLRLSCAASG |
| KERE FW1 sequence no. 11 | SEQ ID NO: 33 | VDSGGGLVQAGDSLKLSCALTG |
| KERE FW1 sequence no. 12 | SEQ ID NO: 34 | VDSGGGLVQAGDSLRLSCAASG |
| KERE FW1 sequence no. 13 | SEQ ID NO: 35 | VDSGGGLVEAGGSLRLSCQVSE |
| KERE FW1 sequence no. 14 | SEQ ID NO: 36 | QDSGGGSVQAGGSLKLSCAASG |
| KERE FW1 sequence no. 15 | SEQ ID NO: 37 | VQSGGRLVQAGDSLRLSCAASE |
| KERE FW1 sequence no. 16 | SEQ ID NO: 38 | VESGGTLVQSGDSLKLSCASST |
| KERE FW1 sequence no. 17 | SEQ ID NO: 39 | MESGGDSVQSGGSLTLSCVASG |
| KERE FW1 sequence no. 18 | SEQ ID NO: 40 | QASGGGLVQAGGSLRLSCSASV | and in which:
iii) FR2, FR3 and FR4 are as mentioned herein for FR2, FR3 and FR4 of NANOBODIES of the KERE-class;

and in which:
iv) CDR1, CDR2 and CDR3 are as defined herein, and are preferably as defined according to one of the preferred aspects herein, and are more preferably as defined according to one of the more preferred aspects herein.

The above NANOBODIES may for example be $V_{HH}$ sequences or may be humanized NANOBODIES. When the above NANOBODY sequences are $V_{HH}$ sequences, they may be suitably humanized, as further described herein. When the NANOBODIES are partially humanized NANO-BODIES, they may optionally be further suitably humanized, again as described herein.

A NANOBODY of the GLEW class may be an amino acid sequence that is comprised of four framework regions/sequences interrupted by three complementarity determining regions/sequences, in which i) preferably, when the NANOBODY of the GLEW-class is a non-humanized NANOBODY, the amino acid residue in position 108 is Q;

ii) FR1 is an amino acid sequence that has at least 80% amino acid identity with at least one of the following amino acid sequences:

TABLE A-15

Representative FW1 sequences for Nanobodies of the GLEW-group.

| | | |
|---|---|---|
| GLEW FW1 sequence no. 1 | SEQ ID NO: 64 | QVQLVESGGGLVQPGGSLRLSCAASGFTFS |
| GLEW FW1 sequence no. 2 | SEQ ID NO: 65 | EVHLVESGGGLVRPGGSLRLSCAAFGFIFK |
| GLEW FW1 sequence no. 3 | SEQ ID NO: 66 | QVKLEESGGGLAQPGGSLRLSCVASGFTFS |
| GLEW FW1 sequence no. 4 | SEQ ID NO: 67 | EVQLVESGGGLVQPGGSLRLSCVCVSSGCT |
| GLEW FW1 sequence no. 5 | SEQ ID NO: 68 | EVQLVESGGGLALPGGSLTLSCVFSGSTFS | and in which:
iii) FR2 is an amino acid sequence that has at least 80% amino acid identity with at least one of the following amino acid sequences:

TABLE A-16

Representative FW2 sequences for Nanobodies of the GLEW-group.

| | | |
|---|---|---|
| GLEW FW2 sequence no. 1 | SEQ ID NO: 72 | WVRQAPGKVLEWVS |
| GLEW FW2 sequence no. 2 | SEQ ID NO: 73 | WVRRPPGKGLEWVS |

TABLE A-16-continued

Representative FW2 sequences for Nanobodies of the GLEW-group.

| | | |
|---|---|---|
| GLEW FW2 sequence no. 3 | SEQ ID NO: 74 | WVRQAPGMGLEWVS |
| GLEW FW2 sequence no. 4 | SEQ ID NO: 75 | WVRQAPGKEPEWVS |
| GLEW FW2 sequence no. 5 | SEQ ID NO: 76 | WVRQAPGKDQEWVS |
| GLEW FW2 sequence no. 6 | SEQ ID NO: 77 | WVRQAPGKAEEWVS |
| GLEW FW2 sequence no. 7 | SEQ ID NO: 78 | WVRQAPGKGLEWVA |
| GLEW FW2 sequence no. 8 | SEQ ID NO: 79 | WVRQAPGRATEWVS | and in which:

iv) FR3 is an amino acid sequence that has at least 80% amino acid identity with at least one of the following amino acid sequences:

TABLE A-17

Representative FW3 sequences for Nanobodies of the GLEW-group.

| | | |
|---|---|---|
| GLEW FW3 sequence no. 1 | SEQ ID NO: 80 | RFTISRDNAKNTLYLQMNSLKPEDTAVYYCVK |
| GLEW FW3 sequence no. 2 | SEQ ID NO: 81 | RFTISRDNARNTLYLQMDSLIPEDTALYYCAR |
| GLEW FW3 sequence no. 3 | SEQ ID NO: 82 | RFTSSRDNAKSTLYLQMNDLKPEDTALYYCAR |
| GLEW FW3 sequence no. 4 | SEQ ID NO: 83 | RFIISRDNAKNTLYLQMNSLGPEDTAMYYCQR |
| GLEW FW3 sequence no. 5 | SEQ ID NO: 84 | RFTASRDNAKNTLYLQMNSLKSEDTARYYCAR |
| GLEW FW3 sequence no. 6 | SEQ ID NO: 85 | RFTISRDNAKNTLYLQMDDLQSEDTAMYYCGR | and in which:

v) FR4 is an amino acid sequence that has at least 80% amino acid identity with at least one of the following amino acid sequences:

TABLE A-18

Representative FW4 sequences for Nanobodies of the GLEW-group.

| | | |
|---|---|---|
| GLEW FW4 sequence no. 1 | SEQ ID NO: 86 | GSQGTQVTVSS |
| GLEW FW4 sequence no. 2 | SEQ ID NO: 87 | LRGGTQVTVSS |
| GLEW FW4 sequence no. 3 | SEQ ID NO: 88 | RGQGTLVTVSS |
| GLEW FW4 sequence no. 4 | SEQ ID NO: 89 | RSRGIQVTVSS |
| GLEW FW4 sequence no. 5 | SEQ ID NO: 90 | WGKGTQVTVSS |
| GLEW FW4 sequence no. 6 | SEQ ID NO: 91 | WGQGTQVTVSS | and in which:

vi) CDR1, CDR2 and CDR3 are as defined herein, and are preferably as defined according to one of the preferred aspects herein, and are more preferably as defined according to one of the more preferred aspects herein.

In the above NANOBODIES, one or more of the further Hallmark residues are preferably as described herein (for example, when they are $V_{HH}$ sequences or partially humanized NANOBODIES).

With regard to framework 1, it will again be clear to the skilled person that, for determining the degree of amino acid identity, the amino acid residues on positions 1 to 4 and 27 to 30 are preferably disregarded.

In view of this, a NANOBODY of the GLEW class may be an amino acid sequence that is comprised of four framework regions/sequences interrupted by three complementarity determining regions/sequences, in which:

i) preferably, when the NANOBODY of the GLEW-class is a non-humanized NANOBODY, the amino acid residue in position 108 is Q;

and in which:

ii) FR1 is an amino acid sequence that, on positions 5 to 26 of the Kabat numbering, has at least 80% amino acid identity with at least one of the following amino acid sequences:

TABLE A-19

Representative FW1 sequences (amino acid residues 5 to 26) for Nanobodies of the KERE-group.

| | | |
|---|---|---|
| GLEW FW1 sequence no. 6 | SEQ ID NO: 69 | VESGGGLVQPGGSLRLSCAASG |
| GLEW FW1 sequence no. 7 | SEQ ID NO: 70 | EESGGGLAQPGGSLRLSCVASG |
| GLEW FW1 sequence no. 8 | SEQ ID NO: 71 | VESGGGLALPGGSLTLSCVFSG | and in which:

iii) FR2, FR3 and FR4 are as mentioned herein for FR2, FR3 and FR4 of NANOBODIES of the GLEW-class; and in which:

iv) CDR1, CDR2 and CDR3 are as defined herein, and are preferably as defined according to one of the preferred aspects herein, and are more preferably as defined according to one of the more preferred aspects herein.

The above NANOBODIES may for example be $V_{HH}$ sequences or may be humanized NANOBODIES. When the above NANOBODY sequences are $V_{HH}$ sequences, they may be suitably humanized, as further described herein. When the NANOBODIES are partially humanized NANOBODIES, they may optionally be further suitably humanized, again as described herein. In the above NANOBODIES, one or more of the further Hallmark residues are preferably as described herein (for example, when they are $V_{HH}$ sequences or partially humanized NANOBODIES).

A NANOBODY of the P, R, S 103 class may be an amino acid sequence that is comprised of four framework regions/sequences interrupted by three complementarity determining regions/sequences, in which i) the amino acid residue at position 103 according to the Kabat numbering is different from W;
and in which:
ii) preferably the amino acid residue at position 103 according to the Kabat numbering is P, R or S, and more preferably R;
and in which:
iii) FR1 is an amino acid sequence that has at least 80% amino acid identity with at least one of the following amino acid sequences:

TABLE A-21

Representative FW2 sequences for Nanobodies of the P, R, S 103-group.

| | | |
|---|---|---|
| P, R, S 103 FW2 sequence no. 1 | SEQ ID NO: 102 | WFRQAPGKEREFVA |
| P, R, S 103 FW2 sequence no. 2 | SEQ ID NO: 103 | WVRQAPGKVLEWVS |
| P, R, S 103 FW2 sequence no. 3 | SEQ ID NO: 104 | WVRRPPGKGLEWVS |
| P, R, S 103 FW2 sequence no. 4 | SEQ ID NO: 105 | WIRQAPGKEREGVS |
| P, R, S 103 FW2 sequence no. 5 | SEQ ID NO: 106 | WVRQYPGKEPEWVS |
| P, R, S 103 FW2 sequence no. 6 | SEQ ID NO: 107 | WFRQPPGKEHEFVA |
| P, R, S 103 FW2 sequence no. 7 | SEQ ID NO: 108 | WYRQAPGKRTELVA |
| P, R, S 103 FW2 sequence no. 8 | SEQ ID NO: 109 | WLRQAPGQGLEWVS |
| P, R, S 103 FW2 sequence no. 9 | SEQ ID NO: 110 | WLRQTPGKGLEWVG |
| P, R, S 103 FW2 sequence no. 10 | SEQ ID NO: 111 | WVRQAPGKAEEFVS |

TABLE A-20

Representative FW1 sequences for Nanobodies of the P, R, S 103-group.

| | | |
|---|---|---|
| P, R, S 103 FW1 sequence no. 1 | SEQ ID NO: 92 | AVQLVESGGGLVQAGGSLRLSCAASGRTFS |
| P, R, S 103 FW1 sequence no. 2 | SEQ ID NO: 93 | QVQLQESGGGMVQPGGSLRLSCAASGFDFG |
| P, R, S 103 FW1 sequence no. 3 | SEQ ID NO: 94 | EVHLVESGGGLVRPGGSLRLSCAAFGFIFK |
| P, R, S 103 FW1 sequence no. 4 | SEQ ID NO: 95 | QVQLAESGGGLVQPGGSLKLSCAASRTIVS |
| P, R, S 103 FW1 sequence no. 5 | SEQ ID NO: 96 | QEHLVESGGGLVDIGGSLRLSCAASERIFS |
| P, R, S 103 FW1 sequence no. 6 | SEQ ID NO: 97 | QVKLEESGGGLAQPGGSLRLSCVASGFTFS |
| P, R, S 103 FW1 sequence no. 7 | SEQ ID NO: 98 | EVQLVESGGGLVQPGGSLRLSCVCVSSGCT |
| P, R, S 103 FW1 sequence no. 8 | SEQ ID NO: 99 | EVQLVESGGGLALPGGSLTLSCVFSGSTFS | and in which iv) FR2 is an amino acid sequence that has at least 80% amino acid identity with at least one of the following amino acid sequences:

and in which:

v) FR3 is an amino acid sequence that has at least 80% amino acid identity with at least one of the following amino acid sequences:

TABLE A-22

Representative FW3 sequences for Nanobodies of the P, R, S 103-group.

| | | |
|---|---|---|
| P, R, S 103 FW3 sequence no. 1 | SEQ ID NO: 112 | RFTISRDNAKNTVYLQMNSLKPEDTAVYYCAA |
| P, R, S 103 FW3 sequence no. 2 | SEQ ID NO: 113 | RFTISRDNARNTLYLQMDSLIPEDTALYYCAR |
| P, R, S 103 FW3 sequence no. 3 | SEQ ID NO: 114 | RFTISRDNAKNEMYLQMNNLKTEDTGVYWCGA |
| P, R, S 103 FW3 sequence no. 4 | SEQ ID NO: 115 | RFTISSDSNRNMIYLQMNNLKPEDTAVYYCAA |
| P, R, S 103 FW3 sequence no. 5 | SEQ ID NO: 116 | RFTISRDNAKNMLYLHLNNLKSEDTAVYYCRR |
| P, R, S 103 FW3 sequence no. 6 | SEQ ID NO: 117 | RFTISRDNAKKTVYLRLNSLNPEDTAVYSCNL |
| P, R, S 103 FW3 sequence no. 7 | SEQ ID NO: 118 | RFKISRDNAKKTLYLQMNSLGPEDTAMYYCQR |
| P, R, S 103 FW3 sequence no. 8 | SEQ ID NO: 119 | RFTVSRDNGKNTAYLRMNSLKPEDTADYYCAV | and in which:

vi) FR4 is an amino acid sequence that has at least 80% amino acid identity with at least one of the following amino acid sequences:

TABLE A-23

Representative FW4 sequences for Nanobodies of the P, R, S 103-group.

| | | |
|---|---|---|
| P, R, S 103 FW4 sequence no. 1 | SEQ ID NO: 120 | RGQGTQVTVSS |
| P, R, S 103 FW4 sequence no. 2 | SEQ ID NO: 121 | LRGGTQVTVSS |
| P, R, S 103 FW4 sequence no. 3 | SEQ ID NO: 122 | GNKGTLVTVSS |
| P, R, S 103 FW4 sequence no. 4 | SEQ ID NO: 123 | SSPGTQVTVSS |
| P, R, S 103 FW4 sequence no. 5 | SEQ ID NO: 124 | SSQGTLVTVSS |
| P, R, S 103 FW4 sequence no. 6 | SEQ ID NO: 125 | RSRGIQVTVSS | and in which:

vii) CDR1, CDR2 and CDR3 are as defined herein, and are preferably as defined according to one of the preferred aspects herein, and are more preferably as defined according to one of the more preferred aspects herein.

In the above NANOBODIES, one or more of the further Hallmark residues are preferably as described herein (for example, when they are $V_{HH}$ sequences or partially humanized NANOBODIES).

With regard to framework 1, it will again be clear to the skilled person that, for determining the degree of amino acid identity, the amino acid residues on positions 1 to 4 and 27 to 30 are preferably disregarded.

In view of this, a NANOBODY of the P, R, S 103 class may be an amino acid sequence that is comprised of four framework regions/sequences interrupted by three complementarity determining regions/sequences, in which:

i) the amino acid residue at position 103 according to the Kabat numbering is different from W;

and in which:

ii) preferably the amino acid residue at position 103 according to the Kabat numbering is P, R or S, and more preferably R;

and in which:

iii) FR1 is an amino acid sequence that, on positions 5 to 26 of the Kabat numbering, has at least 80% amino acid identity with at least one of the following amino acid sequences:

TABLE A-24

Representative FW1 sequences (amino acid residues 5 to 26) for Nanobodies of the P, R, S 103-group.

| | | |
|---|---|---|
| P, R, S 103 FW1 sequence no. 9 | SEQ ID NO: 100 | VESGGGLVQAGGSLRLSCAASG |
| P, R, S 103 FW1 sequence no. 10 | SEQ ID NO: 101 | AESGGGLVQPGGSLKLSCAASR | and in which:

iv) FR2, FR3 and FR4 are as mentioned herein for FR2, FR3 and FR4 of NANOBODIES of the P, R, S 103 class;

and in which:

v) CDR1, CDR2 and CDR3 are as defined herein, and are preferably as defined according to one of the preferred aspects herein, and are more preferably as defined according to one of the more preferred aspects herein.

The above NANOBODIES may for example be $V_{HH}$ sequences or may be humanized NANOBODIES. When the above NANOBODY sequences are $V_{HH}$ sequences, they may be suitably humanized, as further described herein. When the NANOBODIES are partially humanized NANOBODIES, they may optionally be further suitably humanized, again as described herein.

In the above NANOBODIES, one or more of the further Hallmark residues are preferably as described herein (for example, when they are $V_{HH}$ sequences or partially humanized NANOBODIES).

In another preferred, but non-limiting aspect, the invention relates to a NANOBODY as described above, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 560-621. This degree of amino acid identity can for example be determined by determining the degree of amino acid identity (in a manner described herein) between said NANOBODY and one or more of the sequences of SEQ ID NO's: 560-621, in which the amino acid residues that form the framework regions are disregarded. Such NANOBODIES can be as further described herein.

As already mentioned herein, another preferred but non-limiting aspect of the invention relates to a NANOBODY with an amino acid sequence that is chosen from the group consisting of SEQ ID NO's: 560-621 or from the group consisting of from amino acid sequences that have more than 80%, preferably more than 90%, more preferably more than 95%, such as 99% or more sequence identity (as defined herein) with at least one of the amino acid sequences of SEQ ID NO's: 560-621.

Also, in the above NANOBODIES:

i) any amino acid substitution (when it is not a humanizing substitution as defined herein) is preferably, and compared to the corresponding amino acid sequence of SEQ ID NO's: 560-621, a conservative amino acid substitution, (as defined herein);

and/or:

ii) its amino acid sequence preferably contains either only amino acid substitutions, or otherwise preferably no more than 5, preferably no more than 3, and more preferably only 1 or 2 amino acid deletions or insertions, compared to the corresponding amino acid sequence of SEQ ID NO's: 560-621;

and/or iii) the CDR's may be CDR's that are derived by means of affinity maturation, for example starting from the CDR's of to the corresponding amino acid sequence of SEQ ID NO's: 560-621.

Preferably, the CDR sequences and FR sequences in the NANOBODIES of the invention are such that the NANOBODIES of the invention (and polypeptides of the invention comprising the same):

bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter (i.e. with an association constant ($K_A$) of $10^5$ to $10^{12}$ liter/moles or more, and preferably $10^7$ to $10^{12}$ liter/moles or more and more preferably $10^8$ to $10^{12}$ liter/moles);

and/or such that they:

bind to RANK-L with a $k_{on}$-rate of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$;

and/or such that they:

bind to RANK-L with a $k_{off}$ rate between 1 $s^{-1}$ ($t_{1/2}$=0.69 s) and $10^{-6}$ $s^{-1}$ (providing a near irreversible complex with a $t_{1/2}$ of multiple days), preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

Preferably, CDR sequences and FR sequences present in the NANOBODIES of the invention are such that the NANOBODIES of the invention will bind to RANK-L with an affinity less than 500 nM, preferably less than 200 nM, more preferably less than 10 nM, such as less than 500 pM.

According to one non-limiting aspect of the invention, a NANOBODY may be as defined herein, but with the proviso that it has at least "one amino acid difference" (as defined herein) in at least one of the framework regions compared to the corresponding framework region of a naturally occurring human $V_H$ domain, and in particular compared to the corresponding framework region of DP-47. More specifically, according to one non-limiting aspect of the invention, a NANOBODY may be as defined herein, but with the proviso that it has at least "one amino acid difference" (as defined herein) at at least one of the Hallmark residues (including those at positions 108, 103 and/or 45) compared to the corresponding framework region of a naturally occurring human $V_H$ domain, and in particular compared to the corresponding framework region of DP-47. Usually, a NANOBODY will have at least one such amino acid difference with a naturally occurring $V_H$ domain in at least one of FR2 and/or FR4, and in particular at at least one of the Hallmark residues in FR2 and/or FR4 (again, including those at positions 108, 103 and/or 45).

Also, a humanized NANOBODY of the invention may be as defined herein, but with the proviso that it has at least "one amino acid difference" (as defined herein) in at least one of the framework regions compared to the corresponding framework region of a naturally occurring $V_{HH}$ domain. More specifically, according to one non-limiting aspect of the invention, a humanized NANOBODY may be as defined herein, but with the proviso that it has at least "one amino acid difference" (as defined herein) at at least one of the Hallmark residues (including those at positions 108, 103 and/or 45) compared to the corresponding framework region of a naturally occurring $V_{HH}$ domain. Usually, a humanized NANOBODY will have at least one such amino acid difference with a naturally occurring $V_{HH}$ domain in at least one of FR2 and/or FR4, and in particular at at least one of the Hallmark residues in FR2 and/or FR4 (again, including those at positions 108, 103 and/or 45).

As will be clear from the disclosure herein, it is also within the scope of the invention to use natural or synthetic analogs, mutants, variants, alleles, homologs and orthologs (herein collectively referred to as "analogs") of the NANOBODIES of the invention as defined herein, and in particular analogs of the NANOBODIES of SEQ ID NO's: 560-621. Thus, according to one aspect of the invention, the term "NANOBODY of the invention" in its broadest sense also covers such analogs.

Generally, in such analogs, one or more amino acid residues may have been replaced, deleted and/or added, compared to the NANOBODIES of the invention as defined herein. Such substitutions, insertions or deletions may be made in one or more of the framework regions and/or in one or more of the CDR's. When such substitutions, insertions or deletions are made in one or more of the framework regions, they may be made at one or more of the Hallmark residues and/or at one or more of the other positions in the framework residues, although substitutions, insertions or deletions at the Hallmark residues are generally less preferred (unless these are suitable humanizing substitutions as described herein).

By means of non-limiting examples, a substitution may for example be a conservative substitution (as described herein) and/or an amino acid residue may be replaced by another amino acid residue that naturally occurs at the same position in another $V_{HH}$ domain (see Tables A-5 to A-8 for some non-limiting examples of such substitutions), although the invention is generally not limited thereto. Thus, any one or more substitutions, deletions or insertions, or any combination thereof, that either improve the properties of the NANOBODY of the invention or that at least do not detract too much from the desired properties or from the balance or combination of desired properties of the NANOBODY of the invention (i.e. to the extent that the NANOBODY is no longer suited for its intended use) are included within the scope of the invention. A skilled person will generally be able to determine and select suitable substitutions, deletions or insertions, or suitable combinations of thereof, based on the disclosure herein and optionally after a limited degree of routine experimentation, which may for example involve introducing a limited number of possible substitutions and determining their influence on the properties of the NANOBODIES thus obtained.

For example, and depending on the host organism used to express the NANOBODY or polypeptide of the invention, such deletions and/or substitutions may be designed in such a way that one or more sites for post-translational modification (such as one or more glycosylation sites) are removed, as will be within the ability of the person skilled in the art. Alternatively, substitutions or insertions may be designed so as to introduce one or more sites for attachment of functional groups (as described herein), for example to allow site-specific pegylation (again as described herein).

As can be seen from the data on the $V_{HH}$ entropy and $V_{HH}$ variability given in Tables A-5 to A-8 above, some amino acid residues in the framework regions are more conserved than others. Generally, although the invention in its broadest sense is not limited thereto, any substitutions, deletions or insertions are preferably made at positions that are less conserved. Also, generally, amino acid substitutions are preferred over amino acid deletions or insertions.

The analogs are preferably such that they can bind to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the NANOBODIES of the invention.

The analogs are preferably also such that they retain the favourable properties the NANOBODIES, as described herein.

Also, according to one preferred aspect, the analogs have a degree of sequence identity of at least 70%, preferably at least 80%, more preferably at least 90%, such as at least 95% or 99% or more; and/or preferably have at most 20, preferably at most 10, even more preferably at most 5, such as 4, 3, 2 or only 1 amino acid difference (as defined herein), with one of the NANOBODIES of SEQ ID NOs: 560-621.

Also, the framework sequences and CDR's of the analogs are preferably such that they are in accordance with the preferred aspects defined herein. More generally, as described herein, the analogs will have (a) a Q at position 108; and/or (b) a charged amino acid or a cysteine residue at position 45 and preferably an E at position 44, and more preferably E at position 44 and R at position 45; and/or (c) P, R or S at position 103.

One preferred class of analogs of the NANOBODIES of the invention comprise NANOBODIES that have been humanized (i.e. compared to the sequence of a naturally occurring NANOBODY of the invention). As mentioned in the background art cited herein, such humanization generally involves replacing one or more amino acid residues in the sequence of a naturally occurring $V_{HH}$ with the amino acid residues that occur at the same position in a human $V_H$ domain, such as a human $V_H3$ domain. Examples of possible humanizing substitutions or combinations of humanizing substitutions will be clear to the skilled person, for example from the Tables herein, from the possible humanizing substitutions mentioned in the background art cited herein, and/or from a comparison between the sequence of a NANOBODY and the sequence of a naturally occurring human $V_H$ domain.

The humanizing substitutions should be chosen such that the resulting humanized NANOBODIES still retain the favourable properties of NANOBODIES as defined herein, and more preferably such that they are as described for analogs in the preceding paragraphs. A skilled person will generally be able to determine and select suitable humanizing substitutions or suitable combinations of humanizing substitutions, based on the disclosure herein and optionally after a limited degree of routine experimentation, which may for example involve introducing a limited number of possible humanizing substitutions and determining their influence on the properties of the NANOBODIES thus obtained.

Generally, as a result of humanization, the NANOBODIES of the invention may become more "human-like", while still retaining the favorable properties of the NANOBODIES of the invention as described herein. As a result, such humanized NANOBODIES may have several advantages, such as a reduced immunogenicity, compared to the corresponding naturally occurring $V_{HH}$ domains. Again, based on the disclosure herein and optionally after a limited degree of routine experimentation, the skilled person will be able to select humanizing substitutions or suitable combinations of humanizing substitutions which optimize or achieve a desired or suitable balance between the favourable properties provided by the humanizing substitutions on the one hand and the favourable properties of naturally occurring $V_{HH}$ domains on the other hand.

The NANOBODIES of the invention may be suitably humanized at any framework residue(s), such as at one or more Hallmark residues (as defined herein) or at one or more other framework residues (i.e. non-Hallmark residues) or any suitable combination thereof. One preferred humanizing substitution for NANOBODIES of the "P,R,S-103 group" or the "KERE group" is Q108 into L108. NANOBODIES of the "GLEW class" may also be humanized by a Q108 into L108 substitution, provided at least one of the other Hallmark residues contains a camelid (camelizing) substitution (as defined herein). For example, as mentioned above, one particularly preferred class of humanized NANOBODIES has GLEW or a GLEW-like sequence at positions 44-47; P, R or S (and in particular R) at position 103, and an L at position 108.

The humanized and other analogs, and nucleic acid sequences encoding the same, can be provided in any manner known per se. For example, the analogs can be obtained by providing a nucleic acid that encodes a naturally occurring $V_{HH}$ domain, changing the codons for the one or more amino acid residues that are to be substituted into the codons for the corresponding desired amino acid residues (e.g. by site-directed mutagenesis or by PCR using suitable mismatch primers), expressing the nucleic acid/nucleotide sequence thus obtained in a suitable host or expression system; and optionally isolating and/or purifying the analog thus obtained to provide said analog in essentially isolated form (e.g. as further described herein). This can generally be performed using methods and techniques known per se, which will be clear to the skilled person, for example from the handbooks and references cited herein, the background art cited herein and/or from the further description herein. Alternatively, a nucleic acid encoding the desired analog can be synthesized in a manner known per se (for example using an automated apparatus for synthesizing nucleic acid sequences with a predefined amino acid sequence) and can then be expressed as described herein. Yet another technique may involve combining one or more naturally occurring and/or synthetic nucleic acid sequences each encoding a part of the desired analog, and then expressing the combined nucleic acid sequence as described herein. Also, the analogs can be provided using chemical synthesis of the pertinent amino acid sequence using techniques for peptide synthesis known per se, such as those mentioned herein.

In this respect, it will be also be clear to the skilled person that the NANOBODIES of the invention (including their analogs) can be designed and/or prepared starting from human $V_H$ sequences (i.e. amino acid sequences or the corresponding nucleotide sequences), such as for example from human $V_H3$ sequences such as DP-47, DP-51 or DP-29, i.e. by introducing one or more camelizing substitutions (i.e. changing one or more amino acid residues in the amino acid sequence of said human $V_H$ domain into the amino acid residues that occur at the corresponding position in a $V_{HH}$ domain), so as to provide the sequence of a NANOBODY of the invention and/or so as to confer the favourable properties of a NANOBODY to the sequence thus obtained. Again, this can generally be performed using the various methods and techniques referred to in the previous paragraph, using an amino acid sequence and/or nucleotide sequence for a human $V_H$ domain as a starting point.

Some preferred, but non-limiting camelizing substitutions can be derived from Tables A-5-A-8. It will also be clear that camelizing substitutions at one or more of the Hallmark residues will generally have a greater influence on the desired properties than substitutions at one or more of the other amino acid positions, although both and any suitable combination thereof are included within the scope of the invention. For example, it is possible to introduce one or more camelizing substitutions that already confer at least some the desired properties, and then to introduce further camelizing substitutions that either further improve said properties and/or confer additional favourable properties. Again, the skilled person will generally be able to determine and select suitable camelizing substitutions or suitable combinations of camelizing substitutions, based on the disclosure herein and optionally after a limited degree of routine experimentation, which may for example involve introducing a limited number of possible camelizing substitutions and determining whether the favourable properties of NANOBODIES are obtained or improved (i.e. compared to the original $V_H$ domain).

Generally, however, such camelizing substitutions are preferably such that the resulting an amino acid sequence at least contains (a) a Q at position 108; and/or (b) a charged amino acid or a cysteine residue at position 45 and preferably also an E at position 44, and more preferably E at position 44 and R at position 45; and/or (c) P, R or S at position 103; and optionally one or more further camelizing substitutions. More preferably, the camelizing substitutions are such that they result in a NANOBODY of the invention and/or in an analog thereof (as defined herein), such as in a humanized analog and/or preferably in an analog that is as defined in the preceding paragraphs.

Other analogs and nucleic acid sequences encoding the same, can be provided, for example to improve stability of the NANOBODY. During storage, NANOBODIES and other types of immunoglobulins may generate certain variants as a result of:

i) oxidation event(s), occurring in typically only the "accessible" methionines wherein oxidation increases during storage in parallel with incubation temperature and time;

ii) cyclization of the first glutamic acid residue, if present, resulting in formation of pyroglutamate, and iii) isomerization of only the "accessible" aspartic acids or asparagines in a DG, DS, NG or NS motif wherein isomerization increases during storage in parallel with incubation temperature and time.

Analogs of variants of the NANOBODIES of the invention may be generated that have improved stability profile. This can be done, for example, but without being limiting, by avoiding isomerization of Asp (D) and Asn (N), e.g. by replacing the Asp-Gly (DG), Asp-Ser (DS), Asn-Gly (NG) and Asn-Ser (NS) in the CDRs with another amino acid such as e.g. Glu (E) or Gln (Q); by avoiding oxidation of Met e.g. by replacing Met which are susceptible to forced oxidation with another amino acid such as e.g. an Ala or Thr, and/or by replacing N-terminal Glu by an alternative N-terminus, e.g. Asp. Again, the skilled person will generally be able to determine and select suitable stabilizing substitutions or suitable combinations of stabilizing substitutions, based on the disclosure herein and optionally after a limited degree of routine experimentation, which may for example involve introducing a limited number of possible stabilizing substitutions and determining whether the NANOBODIES still bind RANK-L and whether the favourable properties of NANOBODIES are obtained or improved (i.e. compared to the original $V_H$ or $V_{HH}$ domain). A preferred stabilized NANOBODY is depicted in SEQ ID NO: 756) wherein the DS motif in CDR2 is replaced with ES resulting in the following CDR2:

```
SITGSGGSTYYAESVKG.      (SEQ ID NO: 758)
```

As will also be clear from the disclosure herein, it is also within the scope of the invention to use parts or fragments, or combinations of two or more parts or fragments, of the NANOBODIES of the invention as defined herein, and in particular parts or fragments of the NANOBODIES of SEQ ID NO's: 560-621. Thus, according to one aspect of the invention, the term "NANOBODY of the invention" in its broadest sense also covers such parts or fragments.

Generally, such parts or fragments of the NANOBODIES of the invention (including analogs thereof) have amino acid sequences in which, compared to the amino acid sequence of the corresponding full length NANOBODY of the invention (or analog thereof), one or more of the amino acid residues at the N-terminal end, one or more amino acid residues at the C-terminal end, one or more contiguous internal amino acid residues, or any combination thereof, have been deleted and/or removed.

The parts or fragments are preferably such that they can bind to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the NANOBODIES of the invention.

Any part or fragment is preferably such that it comprises at least 10 contiguous amino acid residues, preferably at least 20 contiguous amino acid residues, more preferably at least 30 contiguous amino acid residues, such as at least 40 contiguous amino acid residues, of the amino acid sequence of the corresponding full length NANOBODY of the invention.

Also, any part or fragment is such preferably that it comprises at least one of CDR1, CDR2 and/or CDR3 or at least part thereof (and in particular at least CDR3 or at least part thereof). More preferably, any part or fragment is such that it comprises at least one of the CDR's (and preferably at least CDR3 or part thereof) and at least one other CDR (i.e. CDR1 or CDR2) or at least part thereof, preferably connected by suitable framework sequence(s) or at least part thereof. More preferably, any part or fragment is such that it comprises at least one of the CDR's (and preferably at least CDR3 or part thereof) and at least part of the two remaining CDR's, again preferably connected by suitable framework sequence(s) or at least part thereof.

According to another particularly preferred, but non-limiting aspect, such a part or fragment comprises at least CDR3, such as FR3, CDR3 and FR4 of the corresponding full length NANOBODY of the invention, i.e. as for example described in the International application WO 03/050531 (Lasters et al.).

As already mentioned above, it is also possible to combine two or more of such parts or fragments (i.e. from the same or different NANOBODIES of the invention), i.e. to provide an analog (as defined herein) and/or to provide further parts or fragments (as defined herein) of a NANOBODY of the invention. It is for example also possible to combine one or more parts or fragments of a NANOBODY of the invention with one or more parts or fragments of a human $V_H$ domain.

According to one preferred aspect, the parts or fragments have a degree of sequence identity of at least 50%, preferably at least 60%, more preferably at least 70%, even more preferably at least 80%, such as at least 90%, 95% or 99% or more with one of the NANOBODIES of SEQ ID NOs: 560-621.

The parts and fragments, and nucleic acid sequences encoding the same, can be provided and optionally combined in any manner known per se. For example, such parts or fragments can be obtained by inserting a stop codon in a nucleic acid that encodes a full-sized NANOBODY of the invention, and then expressing the nucleic acid thus obtained in a manner known per se (e.g. as described herein). Alternatively, nucleic acids encoding such parts or fragments can be obtained by suitably restricting a nucleic acid that encodes a full-sized NANOBODY of the invention or by synthesizing such a nucleic acid in a manner known per se. Parts or fragments may also be provided using techniques for peptide synthesis known per se.

The invention in its broadest sense also comprises derivatives of the NANOBODIES of the invention. Such derivatives can generally be obtained by modification, and in particular by chemical and/or biological (e.g. enzymatical) modification, of the NANOBODIES of the invention and/or of one or more of the amino acid residues that form the NANOBODIES of the invention.

Examples of such modifications, as well as examples of amino acid residues within the NANOBODY sequence that can be modified in such a manner (i.e. either on the protein backbone but preferably on a side chain), methods and techniques that can be used to introduce such modifications and the potential uses and advantages of such modifications will be clear to the skilled person.

For example, such a modification may involve the introduction (e.g. by covalent linking or in an other suitable manner) of one or more functional groups, residues or moieties into or onto the NANOBODY of the invention, and in particular of one or more functional groups, residues or moieties that confer one or more desired properties or functionalities to the NANOBODY of the invention. Example of such functional groups will be clear to the skilled person.

For example, such modification may comprise the introduction (e.g. by covalent binding or in any other suitable manner) of one or more functional groups that increase the half-life, the solubility and/or the absorption of the NANOBODY of the invention, that reduce the immunogenicity and/or the toxicity of the NANOBODY of the invention, that eliminate or attenuate any undesirable side effects of the NANOBODY of the invention, and/or that confer other advantageous properties to and/or reduce the undesired properties of the NANOBODIES and/or polypeptides of the invention; or any combination of two or more of the foregoing. Examples of such functional groups and of techniques for introducing them will be clear to the skilled person, and can generally comprise all functional groups and techniques mentioned in the general background art cited hereinabove as well as the functional groups and techniques known per se for the modification of pharmaceutical proteins, and in particular for the modification of antibodies or antibody fragments (including ScFv's and single domain antibodies), for which reference is for example made to Remington's Pharmaceutical Sciences, 16th ed., Mack Publishing Co., Easton, Pa. (1980). Such functional groups may for example be linked directly (for example covalently) to a NANOBODY of the invention, or optionally via a suitable linker or spacer, as will again be clear to the skilled person.

One of the most widely used techniques for increasing the half-life and/or reducing the immunogenicity of pharmaceutical proteins comprises attachment of a suitable pharmacologically acceptable polymer, such as poly(ethyleneglycol) (PEG) or derivatives thereof (such as methoxypoly(ethyleneglycol) or mPEG). Generally, any suitable form of pegylation can be used, such as the pegylation used in the art for antibodies and antibody fragments (including but not limited to (single) domain antibodies and ScFv's); reference is made to for example Chapman, Nat. Biotechnol., 54, 531-545 (2002); by Veronese and Harris, Adv. Drug Deliv. Rev. 54, 453-456 (2003), by Harris and Chess, Nat. Rev. Drug. Discov., 2, (2003) and in WO 04/060965. Various reagents for pegylation of proteins are also commercially available, for example from Nektar Therapeutics, USA.

Preferably, site-directed pegylation is used, in particular via a cysteine-residue (see for example Yang et al., Protein Engineering, 16, 10, 761-770 (2003). For example, for this purpose, PEG may be attached to a cysteine residue that naturally occurs in a NANOBODY of the invention, a NANOBODY of the invention may be modified so as to suitably introduce one or more cysteine residues for attachment of PEG, or an amino acid sequence comprising one or more cysteine residues for attachment of PEG may be fused to the N- and/or C-terminus of a NANOBODY of the invention, all using techniques of protein engineering known per se to the skilled person.

Preferably, for the NANOBODIES and proteins of the invention, a PEG is used with a molecular weight of more than 5000, such as more than 10,000 and less than 200,000, such as less than 100,000; for example in the range of 20,000-80,000.

Another, usually less preferred modification comprises N-linked or O-linked glycosylation, usually as part of co-translational and/or post-translational modification, depending on the host cell used for expressing the NANOBODY or polypeptide of the invention.

Yet another modification may comprise the introduction of one or more detectable labels or other signal-generating groups or moieties, depending on the intended use of the labelled NANOBODY. Suitable labels and techniques for attaching, using and detecting them will be clear to the skilled person, and for example include, but are not limited to, fluorescent labels (such as fluorescein, isothiocyanate, rhodamine, phycoerythrin, phycocyanin, allophycocyanin, o-phthaldehyde, and fluorescamine and fluorescent metals such as $^{152}$Eu or others metals from the lanthanide series), phosphorescent labels, chemiluminescent labels or bioluminescent labels (such as luminal, isoluminol, theromatic acridinium ester, imidazole, acridinium salts, oxalate ester, dioxetane or GFP and its analogs), radio-isotopes (such as $^{3}$H, $^{125}$I, $^{32}$P, $^{35}$S, $^{14}$C, $^{51}$Cr, $^{36}$Cl, $^{57}$Co, $^{58}$Co, $^{59}$Fe, and $^{75}$Se), metals, metal chelates or metallic cations (for example metallic cations such as $^{99m}$Tc, $^{123}$I, $^{111}$In, $^{131}$I, $^{97}$Ru, $^{67}$Cu, $^{67}$Ga, and $^{68}$Ga or other metals or metallic cations that are particularly suited for use in in vivo, in vitro or in situ diagnosis and imaging, such as ($^{157}$Gd, $^{55}$Mn, $^{162}$Dy, $^{52}$Cr, and $^{56}$Fe), as well as chromophores and enzymes (such as malate dehydrogenase, staphylococcal nuclease, delta-V-steroid isomerase, yeast alcohol dehydrogenase, alpha-glycerophosphate dehydrogenase, triose phosphate isomerase, biotinavidin peroxidase, horseradish peroxidase, alkaline phosphatase, asparaginase, glucose oxidase, beta-galactosidase, ribonuclease, urease, catalase, glucose-VI-phosphate dehydrogenase, glucoamylase and acetylcholine esterase). Other suitable labels will be clear to the skilled person, and for example include moieties that can be detected using NMR or ESR spectroscopy.

Such labelled NANOBODIES and polypeptides of the invention may for example be used for in vitro, in vivo or in situ assays (including immunoassays known per se such as ELISA, RIA, EIA and other "sandwich assays", etc.) as well as in vivo diagnostic and imaging purposes, depending on the choice of the specific label.

As will be clear to the skilled person, another modification may involve the introduction of a chelating group, for example to chelate one of the metals or metallic cations referred to above. Suitable chelating groups for example include, without limitation, diethyl-enetriaminepentaacetic acid (DTPA) or ethylenediaminetetraacetic acid (EDTA).

Yet another modification may comprise the introduction of a functional group that is one part of a specific binding pair, such as the biotin-(strept)avidin binding pair. Such a functional group may be used to link the NANOBODY of the invention to another protein, polypeptide or chemical compound that is bound to the other half of the binding pair, i.e. through formation of the binding pair. For example, a NANOBODY of the invention may be conjugated to biotin, and linked to another protein, polypeptide, compound or carrier conjugated to avidin or streptavidin. For example, such a conjugated NANOBODY may be used as a reporter, for example in a diagnostic system where a detectable signal-producing agent is conjugated to avidin or streptavidin. Such binding pairs may for example also be used to bind the NANOBODY of the invention to a carrier, including carriers suitable for pharmaceutical purposes. One non-limiting example are the liposomal formulations described by Cao and Suresh, Journal of Drug Targetting, 8, 4, 257 (2000). Such binding pairs may also be used to link a therapeutically active agent to the NANOBODY of the invention.

For some applications, in particular for those applications in which it is intended to kill a cell that expresses the target against which the NANOBODIES of the invention are directed (e.g. in the treatment of cancer), or to reduce or slow the growth and/or proliferation such a cell, the NANOBODIES of the invention may also be linked to a toxin or to a toxic residue or moiety. Examples of toxic moieties, compounds or residues which can be linked to a NANOBODY of the invention to provide—for example—a cytotoxic compound will be clear to the skilled person and can for example be found in the prior art cited above and/or in the further description herein. One example is the so-called ADEPT™ technology described in WO 03/055527.

Other potential chemical and enzymatical modifications will be clear to the skilled person. Such modifications may also be introduced for research purposes (e.g. to study function-activity relationships). Reference is for example made to Lundblad and Bradshaw, Biotechnol. Appl. Biochem., 26, 143-151 (1997).

Preferably, the derivatives are such that they bind to RANK-L with an affinity (suitably measured and/or expressed as a $K_D$-value (actual or apparent), a $K_A$-value (actual or apparent), a $k_{on}$-rate and/or a $k_{off}$-rate, or alternatively as an $IC_{50}$ value, as further described herein) that is as defined herein for the NANOBODIES of the invention.

As mentioned above, the invention also relates to proteins or polypeptides that essentially consist of or comprise at least one NANOBODY of the invention. By "essentially consist of" is meant that the amino acid sequence of the polypeptide of the invention either is exactly the same as the amino acid sequence of a NANOBODY of the invention or corresponds to the amino acid sequence of a NANOBODY of the invention which has a limited number of amino acid residues, such as 1-20 amino acid residues, for example 1-10 amino acid residues and preferably 1-6 amino acid residues, such as 1, 2, 3, 4, 5 or 6 amino acid residues, added at the amino terminal end, at the carboxy terminal end, or at both the amino terminal end and the carboxy terminal end of the amino acid sequence of the NANOBODY.

Said amino acid residues may or may not change, alter or otherwise influence the (biological) properties of the NANOBODY and may or may not add further functionality to the NANOBODY. For example, such amino acid residues:

can comprise an N-terminal Met residue, for example as result of expression in a heterologous host cell or host organism.

may form a signal sequence or leader sequence that directs secretion of the NANOBODY from a host cell upon synthesis. Suitable secretory leader peptides will be clear to the skilled person, and may be as further described herein. Usually, such a leader sequence will be linked to the N-terminus of the NANOBODY, although the invention in its broadest sense is not limited thereto;

may form a sequence or signal that allows the NANOBODY to be directed towards and/or to penetrate or enter into specific organs, tissues, cells, or parts or compartments of cells, and/or that allows the NANOBODY to penetrate or cross a biological barrier such as a cell membrane, a cell layer such as a layer of epithelial cells, a tumor including solid tumors, or the blood-brain-barrier. Examples of such amino acid sequences will be clear to the skilled person. Some non-limiting examples are the small peptide vectors ("Pep-trans vectors") described in WO 03/026700 and in Temsamani et al., Expert Opin. Biol. Ther., 1, 773 (2001); Temsamani and Vidal, Drug Discov. Today, 9, 1012 (004) and Rousselle, J. Pharmacol. Exp. Ther., 296, 124-131 (2001), and the membrane translocator sequence described by Zhao et al., Apoptosis, 8, 631-637 (2003). C-terminal and N-terminal amino acid sequences for intracellular targeting of antibody fragments are for example described by Cardinale et al., Methods, 34, 171 (2004). Other suitable techniques for intracellular targeting involve the expression and/or use of so-called "intrabodies" comprising a NANOBODY of the invention, as mentioned below;

may form a "tag", for example an amino acid sequence or residue that allows or facilitates the purification of the NANOBODY, for example using affinity techniques directed against said sequence or residue. Thereafter, said sequence or residue may be removed (e.g. by chemical or enzymatical cleavage) to provide the NANOBODY sequence (for this purpose, the tag may optionally be linked to the NANOBODY sequence via a cleavable linker sequence or contain a cleavable motif). Some preferred, but non-limiting examples of such residues are multiple histidine residues, glutathione residues and a myc-tag (see for example SEQ ID NO:31 of WO 06/12282).

may be one or more amino acid residues that have been functionalized and/or that can serve as a site for attachment of functional groups. Suitable amino acid residues and functional groups will be clear to the skilled person and include, but are not limited to, the amino acid residues and functional groups mentioned herein for the derivatives of the NANOBODIES of the invention.

According to another aspect, a polypeptide of the invention comprises a NANOBODY of the invention, which is fused at its amino terminal end, at its carboxy terminal end, or both at its amino terminal end and at its carboxy terminal end to at least one further amino acid sequence, i.e. so as to provide a fusion protein comprising said NANOBODY of the invention and the one or more further amino acid sequences. Such a fusion will also be referred to herein as a "NANOBODY fusion".

The one or more further amino acid sequence may be any suitable and/or desired amino acid sequences. The further amino acid sequences may or may not change, alter or otherwise influence the (biological) properties of the NANOBODY, and may or may not add further functionality to the NANOBODY or the polypeptide of the invention. Preferably, the further amino acid sequence is such that it confers one or more desired properties or functionalities to the NANOBODY or the polypeptide of the invention.

For example, the further amino acid sequence may also provide a second binding site, which binding site may be directed against any desired protein, polypeptide, antigen, antigenic determinant or epitope (including but not limited to the same protein, polypeptide, antigen, antigenic determinant or epitope against which the NANOBODY of the invention is directed, or a different protein, polypeptide, antigen, antigenic determinant or epitope).

Example of such amino acid sequences will be clear to the skilled person, and may generally comprise all amino acid sequences that are used in peptide fusions based on conventional antibodies and fragments thereof (including but not limited to ScFv's and single domain antibodies). Reference is for example made to the review by Holliger and Hudson, Nature Biotechnology, 23, 9, 1126-1136 (2005).

For example, such an amino acid sequence may be an amino acid sequence that increases the half-life, the solubility, or the absorption, reduces the immunogenicity or the toxicity, eliminates or attenuates undesirable side effects, and/or confers other advantageous properties to and/or reduces the undesired properties of the polypeptides of the invention, compared to the NANOBODY of the invention per se. Some non-limiting examples of such amino acid sequences are serum proteins, such as human serum albumin (see for example WO 00/27435) or haptenic molecules (for example haptens that are recognized by circulating antibodies, see for example WO 98/22141).

In particular, it has been described in the art that linking fragments of immunoglobulins (such as $V_H$ domains) to serum albumin or to fragments thereof can be used to increase the half-life. Reference is for made to WO 00/27435 and WO 01/077137). According to the invention, the NANOBODY of the invention is preferably either directly linked to serum albumin (or to a suitable fragment thereof) or via a suitable linker, and in particular via a suitable peptide linked so that the polypeptide of the invention can be expressed as a genetic fusion (protein). According to one specific aspect, the NANOBODY of the invention may be linked to a fragment of serum albumin that at least comprises the domain III of serum albumin or part thereof. Reference is for example made to WO 07/112940 of Ablynx N.V.

Alternatively, the further amino acid sequence may provide a second binding site or binding unit that is directed against a serum protein (such as, for example, human serum albumin or another serum protein such as IgG), so as to provide increased half-life in serum. Such amino acid sequences for example include the NANOBODIES described below, as well as the small peptides and binding proteins described in WO 91/01743, WO 01/45746 and WO 02/076489 and the dAb's described in WO 03/002609 and WO 04/003019. Reference is also made to Harmsen et al., Vaccine, 23 (41); 4926-42, 2005, as well as to EP 0 368 684, as well as to the following the U.S. provisional applications 60/843,349 (see also PCT/EP2007/059475), 60/850,774 (see also PCT/EP2007/060849), 60/850,775 (see also PCT/EP2007/060850) by Ablynx N.V. mentioned herein and US provisional application of Ablynx N.V. entitled "Peptides capable of binding to serum proteins" filed on Dec. 5, 2006 (see also PCT/EP2007/063348).

Such amino acid sequences may in particular be directed against serum albumin (and more in particular human serum albumin) and/or against IgG (and more in particular human IgG). For example, such amino acid sequences may be amino acid sequences that are directed against (human) serum albumin and amino acid sequences that can bind to amino acid residues on (human) serum albumin that are not involved in binding of serum albumin to FcRn (see for example WO 06/0122787) and/or amino acid sequences that are capable of binding to amino acid residues on serum albumin that do not form part of domain III of serum albumin (see again for example WO 06/0122787); amino acid sequences that have or can provide an increased half-life (see for example WO 08/028977 by Ablynx N.V.); amino acid sequences against human serum albumin that are cross-reactive with serum albumin from at least one species of mammal, and in particular with at least one species of primate (such as, without limitation, monkeys from the genus *Macaca* (such as, and in particular, cynomolgus monkeys (*Macaca fascicularis*) and/or rhesus monkeys (*Macaca mulatta*)) and baboon (*Papio ursinus*), reference is again made to the U.S. provisional application 60/843,349 and PCT/EP2007/059475); amino acid sequences that can bind to serum albumin in a pH independent manner (see for example the U.S. provisional application 60/850,774 by Ablynx N.V. entitled "Amino acid sequences that bind to serum proteins in a manner that is essentially independent of the pH, compounds comprising the same, and uses thereof", filed on Oct. 11, 2006; see also and PCT/EP2007/059475) and/or amino acid sequences that are conditional binders (see for example the U.S. provisional application 60/850, 775 by Ablynx N.V. entitled "Amino acid sequences that bind to a desired molecule in a conditional manner", filed on Oct. 11, 2006; see also PCT/EP2007/060850).

According to another aspect, the one or more further amino acid sequences may comprise one or more parts, fragments or domains of conventional 4-chain antibodies (and in particular human antibodies) and/or of heavy chain antibodies. For example, although usually less preferred, a NANOBODY of the invention may be linked to a conventional (preferably human) $V_H$ or $V_L$ domain or to a natural or synthetic analog of a $V_H$ or $V_L$ domain, again optionally via a linker sequence (including but not limited to other (single) domain antibodies, such as the dAb's described by Ward et al.).

The at least one NANOBODY may also be linked to one or more (preferably human) $C_H1$, $C_H2$ and/or $C_H3$ domains, optionally via a linker sequence. For instance, a NANOBODY linked to a suitable $C_H1$ domain could for example be used—together with suitable light chains—to generate antibody fragments/structures analogous to conventional Fab fragments or F(ab')$_2$ fragments, but in which one or (in case of an F(ab')$_2$ fragment) one or both of the conventional $V_H$ domains have been replaced by a NANOBODY of the invention. Also, two NANOBODIES could be linked to a $C_H3$ domain (optionally via a linker) to provide a construct with increased half-life in vivo.

According to one specific aspect of a polypeptide of the invention, one or more NANOBODIES of the invention may be linked (optionally via a suitable linker or hinge region) to one or more constant domains (for example, 2 or 3 constant domains that can be used as part of/to form an Fc portion), to an Fc portion and/or to one or more antibody parts, fragments or domains that confer one or more effector functions to the polypeptide of the invention and/or may confer the ability to bind to one or more Fc receptors. For example, for this purpose, and without being limited thereto, the one or more further amino acid sequences may comprise one or more $C_H2$ and/or $C_H3$ domains of an antibody, such as from a heavy chain antibody (as described herein) and more preferably from a conventional human 4-chain antibody; and/or may form (part of) and Fc region, for example from IgG (e.g. from IgG1, IgG2, IgG3 or IgG4), from IgE or from another human Ig such as IgA, IgD or IgM. For example, WO 94/04678 describes heavy chain antibodies comprising a Camelid $V_{HH}$ domain or a humanized derivative thereof (i.e. a NANOBODY), in which the Camelidae $C_H2$ and/or $C_H3$ domain have been replaced by human $C_H2$ and $C_H3$ domains, so as to provide an immunoglobulin that consists of 2 heavy chains each comprising a NANOBODY and human $C_H2$ and $C_H3$ domains (but no $C_H1$ domain), which immunoglobulin has the effector function provided by the $C_H2$ and $C_H3$ domains and which immunoglobulin can function without the presence of any light chains. Other amino acid sequences that can be suitably linked to the NANOBODIES of the invention so as to provide an effector function will be clear to the skilled person, and may be chosen on the basis of the desired effector function(s). Reference is for example made to WO 04/058820, WO 99/42077, WO 02/056910 and WO 05/017148, as well as the review by Holliger and Hudson, supra and to the non-prepublished US provisional application by Ablynx N.V. entitled "Constructs comprising single variable domains and an Fc portion derived from IgE" which has a filing date of Dec. 4, 2007. Coupling of a NANOBODY of the invention to an Fc portion may also lead to an increased half-life, compared to the corresponding NANOBODY of the invention. For some applications, the use of an Fc portion and/or of constant domains (i.e. $C_H2$ and/or $C_H3$ domains) that confer increased half-life without any biologically significant effector function may also be suitable or even preferred. Other suitable constructs comprising one or more NANOBODIES and one or more constant domains with increased half-life in vivo will be clear to the skilled person, and may for example comprise two NANOBODIES linked to a $C_H3$ domain, optionally via a linker sequence. Generally, any fusion protein or derivatives with increased half-life will preferably have a molecular weight of more than 50 kD, the cut-off value for renal absorption.

In another one specific, but non-limiting, aspect, in order to form a polypeptide of the invention, one or more amino acid sequences of the invention may be linked (optionally via a suitable linker or hinge region) to naturally occurring, synthetic or semisynthetic constant domains (or analogs, variants, mutants, parts or fragments thereof) that have a reduced (or essentially no) tendency to self-associate into dimers (i.e. compared to constant domains that naturally occur in conventional 4-chain antibodies). Such monomeric (i.e. not self-associating) Fc chain variants, or fragments thereof, will be clear to the skilled person. For example, Helm et al., J Biol Chem 1996 271 7494, describe monomeric Fcε chain variants that can be used in the polypeptide chains of the invention.

Also, such monomeric Fc chain variants are preferably such that they are still capable of binding to the complement or the relevant Fc receptor(s) (depending on the Fc portion from which they are derived), and/or such that they still have some or all of the effector functions of the Fc portion from which they are derived (or at a reduced level still suitable for the intended use). Alternatively, in such a polypeptide chain of the invention, the monomeric Fc chain may be used to confer increased half-life upon the polypeptide chain, in which case the monomeric Fc chain may also have no or essentially no effector functions.

Bivalent/multivalent, bispecific/multispecific or biparatopic/multiparatopic polypeptides of the invention may also be linked to Fc portions, in order to provide polypeptide constructs of the type that is described in the non-prepublished US provisional application U.S. 61/005, 331 entitled "immunoglobulin constructs" filed on Dec. 4, 2007.

The further amino acid sequences may also form a signal sequence or leader sequence that directs secretion of the NANOBODY or the polypeptide of the invention from a host cell upon synthesis (for example to provide a pre-, pro- or prepro-form of the polypeptide of the invention, depending on the host cell used to express the polypeptide of the invention).

The further amino acid sequence may also form a sequence or signal that allows the NANOBODY or polypeptide of the invention to be directed towards and/or to penetrate or enter into specific organs, tissues, cells, or parts or compartments of cells, and/or that allows the NANOBODY or polypeptide of the invention to penetrate or cross a biological barrier such as a cell membrane, a cell layer such as a layer of epithelial cells, a tumor including solid tumors, or the blood-brain-barrier. Suitable examples of such amino acid sequences will be clear to the skilled person, and for example include, but are not limited to, the "Peptrans" vectors mentioned above, the sequences described by Cardinale et al. and the amino acid sequences and antibody fragments known per se that can be used to express or produce the NANOBODIES and polypeptides of the invention as so-called "intrabodies", for example as described in WO 94/02610, WO 95/22618, U.S. Pat. No. 7,004,940, WO 03/014960, WO 99/07414; WO 05/01690; EP 1 512 696; and in Cattaneo, A. & Biocca, S. (1997) Intracellular Antibodies: Development and Applications. Landes and Springer-Verlag; and in Kontermann, Methods 34, (2004), 163-170, and the further references described therein.

For some applications, in particular for those applications in which it is intended to kill a cell that expresses the target against which the NANOBODIES of the invention are directed (e.g. in the treatment of cancer), or to reduce or slow the growth and/or proliferation of such a cell, the NANOBODIES of the invention may also be linked to a (cyto)toxic protein or polypeptide. Examples of such toxic proteins and polypeptides which can be linked to a NANOBODY of the invention to provide—for example—a cytotoxic polypeptide of the invention will be clear to the skilled person and can for example be found in the prior art cited above and/or in the further description herein. One example is the so-called ADEPT™ technology described in WO 03/055527.

According to one preferred, but non-limiting aspect, said one or more further amino acid sequences comprise at least one further NANOBODY, so as to provide a polypeptide of the invention that comprises at least two, such as three, four, five or more NANOBODIES, in which said NANOBODIES may optionally be linked via one or more linker sequences (as defined herein). Polypeptides of the invention that comprise two or more NANOBODIES, of which at least one is a NANOBODY of the invention, will also be referred to herein as "multivalent" polypeptides of the invention, and the NANOBODIES present in such polypeptides will also be referred to herein as being in a "multivalent format". For example a "bivalent" polypeptide of the invention comprises two NANOBODIES, optionally linked via a linker sequence, whereas a "trivalent" polypeptide of the invention comprises three NANOBODIES, optionally linked via two linker sequences; etc.; in which at least one of the NANOBODIES present in the polypeptide, and up to all of the NANOBODIES present in the polypeptide, is/are a NANOBODY of the invention.

In a multivalent polypeptide of the invention, the two or more NANOBODIES may be the same or different, and may be directed against the same antigen or antigenic determinant (for example against the same part(s) or epitope(s) or against different parts or epitopes) or may alternatively be directed against different antigens or antigenic determinants; or any suitable combination thereof. For example, a bivalent polypeptide of the invention may comprise (a) two identical NANOBODIES; (b) a first NANOBODY directed against a first antigenic determinant of a protein or antigen and a second NANOBODY directed against the same antigenic determinant of said protein or antigen which is different from the first NANOBODY; (c) a first NANOBODY directed against a first antigenic determinant of a protein or antigen and a second NANOBODY directed against another antigenic determinant of said protein or antigen; or (d) a first NANOBODY directed against a first protein or antigen and a second NANOBODY directed against a second protein or antigen (i.e. different from said first antigen). Similarly, a trivalent polypeptide of the invention may, for example and without being limited thereto. comprise (a) three identical NANOBODIES; (b) two identical NANOBODY against a first antigenic determinant of an antigen and a third NANOBODY directed against a different antigenic determinant of the same antigen; (c) two identical NANOBODY against a first antigenic determinant of an antigen and a third NANOBODY directed against a second antigen different from said first antigen; (d) a first NANOBODY directed against a first antigenic determinant of a first antigen, a second NANOBODY directed against a second antigenic determinant of said first antigen and a third NANOBODY directed against a second antigen different from said first antigen; or (e) a first NANOBODY directed against a first antigen, a second NANOBODY directed against a second antigen different from said first antigen, and a third NANOBODY directed against a third antigen different from said first and second antigen.

Polypeptides of the invention that contain at least two NANOBODIES, in which at least one NANOBODY is directed against a first antigen (i.e. against RANK-L) and at least one NANOBODY is directed against a second antigen (i.e. different from RANK-L), will also be referred to as "multispecific" polypeptides of the invention, and the NANOBODIES present in such polypeptides will also be referred to herein as being in a "multispecific format". Thus, for example, a "bispecific" polypeptide of the invention is a polypeptide that comprises at least one NANOBODY directed against a first antigen (i.e. RANK-L) and at least one further NANOBODY directed against a second antigen (i.e. different from RANK-L), whereas a "trispecific" polypeptide of the invention is a polypeptide that comprises at least one NANOBODY directed against a first antigen (i.e. RANK-L), at least one further NANOBODY directed against a second antigen (i.e. different from RANK-L) and at least one further NANOBODY directed against a third antigen (i.e. different from both RANK-L, and the second antigen); etc.

Accordingly, in its simplest form, a bispecific polypeptide of the invention is a bivalent polypeptide of the invention (as defined herein), comprising a first NANOBODY directed against RANK-L, and a second NANOBODY directed against a second antigen, in which said first and second NANOBODY may optionally be linked via a linker sequence (as defined herein); whereas a trispecific polypeptide of the invention in its simplest form is a trivalent polypeptide of the invention (as defined herein), comprising a first NANOBODY directed against RANK-L, a second NANOBODY directed against a second antigen and a third NANOBODY directed against a third antigen, in which said first, second and third NANOBODY may optionally be linked via one or more, and in particular one and more, in particular two, linker sequences.

However, as will be clear from the description hereinabove, the invention is not limited thereto, in the sense that a multispecific polypeptide of the invention may comprise at least one NANOBODY against RANK-L, and any number of NANOBODIES directed against one or more antigens different from RANK-L.

Furthermore, although it is encompassed within the scope of the invention that the specific order or arrangement of the various NANOBODIES in the polypeptides of the invention may have some influence on the properties of the final polypeptide of the invention (including but not limited to the affinity, specificity or avidity for RANK-L, or against the one or more other antigens), said order or arrangement is usually not critical and may be suitably chosen by the skilled person, optionally after some limited routine experiments based on the disclosure herein. Thus, when reference is made to a specific multivalent or multispecific polypeptide of the invention, it should be noted that this encompasses any order or arrangements of the relevant NANOBODIES, unless explicitly indicated otherwise.

Finally, it is also within the scope of the invention that the polypeptides of the invention contain two or more NANOBODIES and one or more further amino acid sequences (as mentioned herein).

For multivalent and multispecific polypeptides containing one or more $V_{HH}$ domains and their preparation, reference is also made to Conrath et al., J. Biol. Chem., Vol. 276, 10. 7346-7350, 2001; Muyldermans, Reviews in Molecular Biotechnology 74 (2001), 277-302; as well as to for example WO 96/34103 and WO 99/23221. Some other examples of some specific multispecific and/or multivalent polypeptide of the invention can be found in the applications by Ablynx N.V. referred to herein.

One preferred, but non-limiting example of a multispecific polypeptide of the invention comprises at least one NANOBODY of the invention and at least one NANOBODY that provides for an increased half-life. Such NANOBODIES may for example be NANOBODIES that are directed against a serum protein, and in particular a human serum protein, such as human serum albumin, thyroxine-binding protein, (human) transferrin, fibrinogen, an immunoglobulin such as IgG, IgE or IgM, or against one of the serum proteins listed in WO 04/003019. Of these, NANOBODIES that can bind to serum albumin (and in particular human serum albumin) or to IgG (and in particular human IgG, see for example NANOBODY VH-1 described in the review by Muyldermans, supra) are particularly preferred (although for example, for experiments in mice or primates, NANOBODIES against or cross-reactive with mouse serum albumin (MSA) or serum albumin from said primate, respectively, can be used. However, for pharmaceutical use, NANOBODIES against human serum albumin or human IgG will usually be preferred). NANOBODIES that provide for increased half-life and that can be used in the polypeptides of the invention include the NANOBODIES directed against serum albumin that are described in WO 04/041865, in WO 06/122787 and in the further patent applications by Ablynx N.V., such as those mentioned above.

For example, the some preferred NANOBODIES that provide for increased half-life for use in the present invention include NANOBODIES that can bind to amino acid residues on (human) serum albumin that are not involved in binding of serum albumin to FcRn (see for example WO 06/0122787); NANOBODIES that are capable of binding to amino acid residues on serum albumin that do not form part of domain III of serum albumin (see for example WO 06/0122787); NANOBODIES that have or can provide an increased half-life (see for example the U.S. provisional application 60/843,349 by Ablynx N.V mentioned herein; see also PCT/EP2007/059475); NANOBODIES against human serum albumin that are cross-reactive with serum albumin from at least one species of mammal, and in particular with at least one species of primate (such as, without limitation, monkeys from the genus Macaca (such as, and in particular, cynomolgus monkeys (Macaca fascicularis) and/or rhesus monkeys (Macaca mulatta)) and baboon (Papio ursinus)) (see for example the U.S. provisional application 60/843,349 by Ablynx N.V; see also PCT/EP2007/059475); NANOBODIES that can bind to serum albumin in a pH independent manner (see for example the U.S. provisional application 60/850,774 by Ablynx N.V.; see also PCT/EP2007/060849) and/or NANOBODIES that are conditional binders (see for example the U.S. provisional application 60/850,775 by Ablynx N.V.; see also PCT/EP2007/060850).

Some particularly preferred NANOBODIES that provide for increased half-life and that can be used in the polypeptides of the invention include the NANOBODIES ALB-1 to ALB-10 disclosed in WO 06/122787 (see Tables II and III) of which ALB-8 (SEQ ID NO: 62 in WO 06/122787) is particularly preferred.

Some preferred, but non-limiting examples of polypeptides of the invention that comprise at least one NANOBODY of the invention and at least one NANOBODY that provides for increased half-life are given in SEQ ID NO's 694-729 and 759-760.

According to a specific, but non-limiting aspect of the invention, the polypeptides of the invention contain, besides the one or more NANOBODIES of the invention, at least one NANOBODY against human serum albumin.

Generally, any polypeptides of the invention with increased half-life that contain one or more NANOBODIES of the invention, and any derivatives of NANOBODIES of the invention or of such polypeptides that have an increased half-life, preferably have a half-life that is at least 1.5 times, preferably at least 2 times, such as at least 5 times, for example at least 10 times or more than 20 times, greater than the half-life of the corresponding NANOBODY of the invention per se. For example, such a derivative or polypeptides with increased half-life may have a half-life that is increased with more than 1 hours, preferably more than 2 hours, more preferably more than 6 hours, such as more than 12 hours, or even more than 24, 48 or 72 hours, compared to the corresponding NANOBODY of the invention per se.

In a preferred, but non-limiting aspect of the invention, such derivatives or polypeptides may exhibit a serum half-life in human of at least about 12 hours, preferably at least 24 hours, more preferably at least 48 hours, even more preferably at least 72 hours or more. For example, such derivatives or polypeptides may have a half-life of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

According to one aspect of the invention the polypeptides are capable of binding to one or more molecules which can increase the half-life of the polypeptide in vivo.

The polypeptides of the invention are stabilised in vivo and their half-life increased by binding to molecules which resist degradation and/or clearance or sequestration. Typically, such molecules are naturally occurring proteins which themselves have a long half-life in vivo.

Another preferred, but non-limiting example of a multi-specific polypeptide of the invention comprises at least one NANOBODY of the invention and at least one NANOBODY that directs the polypeptide of the invention towards, and/or that allows the polypeptide of the invention to penetrate or to enter into specific organs, tissues, cells, or parts or compartments of cells, and/or that allows the NANOBODY to penetrate or cross a biological barrier such as a cell membrane, a cell layer such as a layer of epithelial cells, a tumor including solid tumors, or the blood-brain-barrier. Examples of such NANOBODIES include NANOBODIES that are directed towards specific cell-surface proteins, markers or epitopes of the desired organ, tissue or cell (for example cell-surface markers associated with tumor cells), and the single-domain brain targeting antibody fragments described in WO 02/057445 and WO 06/040153, of which FC44 (SEQ ID NO: 189 of WO 06/040153) and FC5 (SEQ ID NO: 190 of WO 06/040154) are preferred examples.

In the polypeptides of the invention, the one or more NANOBODIES and the one or more polypeptides may be directly linked to each other (as for example described in WO 99/23221) and/or may be linked to each other via one or more suitable spacers or linkers, or any combination thereof.

Suitable spacers or linkers for use in multivalent and multispecific polypeptides will be clear to the skilled person, and may generally be any linker or spacer used in the art to link amino acid sequences. Preferably, said linker or spacer is suitable for use in constructing proteins or polypeptides that are intended for pharmaceutical use.

Some particularly preferred spacers include the spacers and linkers that are used in the art to link antibody fragments or antibody domains. These include the linkers mentioned in the general background art cited above, as well as for example linkers that are used in the art to construct diabodies or ScFv fragments (in this respect, however, its should be noted that, whereas in diabodies and in ScFv fragments, the linker sequence used should have a length, a degree of flexibility and other properties that allow the pertinent $V_H$ and $V_L$ domains to come together to form the complete antigen-binding site, there is no particular limitation on the length or the flexibility of the linker used in the polypeptide of the invention, since each NANOBODY by itself forms a complete antigen-binding site).

For example, a linker may be a suitable amino acid sequence, and in particular amino acid sequences of between 1 and 50, preferably between 1 and 30, such as between 1 and 10 amino acid residues. Some preferred examples of such amino acid sequences include gly-ser linkers, for example of the type $(gly_xser_y)_z$, such as (for example $(gly_4ser_2)_3$ or $(gly_3ser_2)_3$, as described in WO 99/42077 and the GS30, GS15, GS9 and GS7 linkers described in the applications by Ablynx mentioned herein (see for example WO 06/040153 and WO 06/122825), as well as hinge-like regions, such as the hinge regions of naturally occurring heavy chain antibodies or similar sequences (such as described in WO 94/04678).

Some other particularly preferred linkers are poly-alanine (such as AAA), as well as the linkers GS30 (SEQ ID NO: 85 in WO 06/122825) and GS9 (SEQ ID NO: 84 in WO 06/122825).

Other suitable linkers generally comprise organic compounds or polymers, in particular those suitable for use in proteins for pharmaceutical use. For instance, poly(ethyleneglycol) moieties have been used to link antibody domains, see for example WO 04/081026.

It is encompassed within the scope of the invention that the length, the degree of flexibility and/or other properties of the linker(s) used (although not critical, as it usually is for linkers used in ScFv fragments) may have some influence on the properties of the final polypeptide of the invention, including but not limited to the affinity, specificity or avidity for RANK-L, or for one or more of the other antigens. Based on the disclosure herein, the skilled person will be able to determine the optimal linker(s) for use in a specific polypeptide of the invention, optionally after some limited routine experiments.

For example, in multivalent polypeptides of the invention that comprise NANOBODIES directed against a multimeric antigen (such as a multimeric receptor or other protein), the length and flexibility of the linker are preferably such that it allows each NANOBODY of the invention present in the polypeptide to bind to the antigenic determinant on each of the subunits of the multimer. Similarly, in a multispecific polypeptide of the invention that comprises NANOBODIES directed against two or more different antigenic determinants on the same antigen (for example against different epitopes of an antigen and/or against different subunits of a multimeric receptor, channel or protein), the length and flexibility of the linker are preferably such that it allows each NANOBODY to bind to its intended antigenic determinant. Again, based on the disclosure herein, the skilled person will be able to determine the optimal linker(s) for use in a specific polypeptide of the invention, optionally after some limited routine experiments.

It is also within the scope of the invention that the linker(s) used confer one or more other favourable properties or functionality to the polypeptides of the invention, and/or provide one or more sites for the formation of derivatives and/or for the attachment of functional groups (e.g. as described herein for the derivatives of the NANOBODIES of the invention). For example, linkers containing one or more charged amino acid residues (see Table A-2 above) can provide improved hydrophilic properties, whereas linkers that form or contain small epitopes or tags can be used for the purposes of detection, identification and/or purification. Again, based on the disclosure herein, the skilled person will be able to determine the optimal linkers for use in a specific polypeptide of the invention, optionally after some limited routine experiments.

Finally, when two or more linkers are used in the polypeptides of the invention, these linkers may be the same or different. Again, based on the disclosure herein, the skilled person will be able to determine the optimal linkers for use in a specific polypeptide of the invention, optionally after some limited routine experiments.

Usually, for easy of expression and production, a polypeptide of the invention will be a linear polypeptide. However, the invention in its broadest sense is not limited thereto. For example, when a polypeptide of the invention comprises three of more NANOBODIES, it is possible to link them by use of a linker with three or more "arms", which each "arm" being linked to a NANOBODY, so as to provide a "star-shaped" construct. It is also possible, although usually less preferred, to use circular constructs.

The invention also comprises derivatives of the polypeptides of the invention, which may be essentially analogous to the derivatives of the NANOBODIES of the invention, i.e. as described herein.

The invention also comprises proteins or polypeptides that "essentially consist" of a polypeptide of the invention (in which the wording "essentially consist of" has essentially the same meaning as indicated hereinabove).

According to one aspect of the invention, the polypeptide of the invention is in essentially isolated from, as defined herein.

The amino acid sequences, NANOBODIES, polypeptides and nucleic acids of the invention can be prepared in a manner known per se, as will be clear to the skilled person from the further description herein. For example, the NANOBODIES and polypeptides of the invention can be prepared in any manner known per se for the preparation of antibodies and in particular for the preparation of antibody fragments (including but not limited to (single) domain antibodies and ScFv fragments). Some preferred, but non-limiting methods for preparing the amino acid sequences, NANOBODIES, polypeptides and nucleic acids include the methods and techniques described herein.

As will be clear to the skilled person, one particularly useful method for preparing an amino acid sequence, NANOBODY and/or a polypeptide of the invention generally comprises the steps of:
i) the expression, in a suitable host cell or host organism (also referred to herein as a "host of the invention") or in another suitable expression system of a nucleic acid that encodes said amino acid sequence, NANOBODY or polypeptide of the invention (also referred to herein as a "nucleic acid of the invention"), optionally followed by:
ii) isolating and/or purifying the amino acid sequence, NANOBODY or polypeptide of the invention thus obtained.

In particular, such a method may comprise the steps of:
i) cultivating and/or maintaining a host of the invention under conditions that are such that said host of the invention expresses and/or produces at least one amino acid sequence, NANOBODY and/or polypeptide of the invention; optionally followed by:
ii) isolating and/or purifying the amino acid sequence, NANOBODY or polypeptide of the invention thus obtained.

A nucleic acid of the invention can be in the form of single or double stranded DNA or RNA, and is preferably in the form of double stranded DNA. For example, the nucleotide sequences of the invention may be genomic DNA, cDNA or synthetic DNA (such as DNA with a codon usage that has been specifically adapted for expression in the intended host cell or host organism).

According to one aspect of the invention, the nucleic acid of the invention is in essentially isolated from, as defined herein.

The nucleic acid of the invention may also be in the form of, be present in and/or be part of a vector, such as for example a plasmid, cosmid or YAC, which again may be in essentially isolated form.

The nucleic acids of the invention can be prepared or obtained in a manner known per se, based on the information on the amino acid sequences for the polypeptides of the invention given herein, and/or can be isolated from a suitable natural source. To provide analogs, nucleotide sequences encoding naturally occurring $V_{HH}$ domains can for example be subjected to site-directed mutagenesis, so at to provide a nucleic acid of the invention encoding said analog. Also, as will be clear to the skilled person, to prepare a nucleic acid of the invention, also several nucleotide sequences, such as at least one nucleotide sequence encoding a NANOBODY and for example nucleic acids encoding one or more linkers can be linked together in a suitable manner.

Techniques for generating the nucleic acids of the invention will be clear to the skilled person and may for instance include, but are not limited to, automated DNA synthesis; site-directed mutagenesis; combining two or more naturally occurring and/or synthetic sequences (or two or more parts thereof), introduction of mutations that lead to the expression of a truncated expression product; introduction of one or more restriction sites (e.g. to create cassettes and/or regions that may easily be digested and/or ligated using suitable restriction enzymes), and/or the introduction of mutations by means of a PCR reaction using one or more "mismatched" primers. These and other techniques will be clear to the skilled person, and reference is again made to the standard handbooks, such as Sambrook et al. and Ausubel et al., mentioned above, as well as the Examples below.

The nucleic acid of the invention may also be in the form of, be present in and/or be part of a genetic construct, as will be clear to the person skilled in the art. Such genetic constructs generally comprise at least one nucleic acid of the invention that is optionally linked to one or more elements of genetic constructs known per se, such as for example one or more suitable regulatory elements (such as a suitable promoter(s), enhancer(s), terminator(s), etc.) and the further elements of genetic constructs referred to herein. Such genetic constructs comprising at least one nucleic acid of the invention will also be referred to herein as "genetic constructs of the invention".

The genetic constructs of the invention may be DNA or RNA, and are preferably double-stranded DNA. The genetic constructs of the invention may also be in a form suitable for transformation of the intended host cell or host organism, in a form suitable for integration into the genomic DNA of the intended host cell or in a form suitable for independent replication, maintenance and/or inheritance in the intended host organism. For instance, the genetic constructs of the invention may be in the form of a vector, such as for example a plasmid, cosmid, YAC, a viral vector or transposon. In particular, the vector may be an expression vector, i.e. a vector that can provide for expression in vitro and/or in vivo (e.g. in a suitable host cell, host organism and/or expression system).

In a preferred but non-limiting aspect, a genetic construct of the invention comprises
i) at least one nucleic acid of the invention; operably connected to
ii) one or more regulatory elements, such as a promoter and optionally a suitable terminator;
and optionally also
iii) one or more further elements of genetic constructs known per se;
in which the terms "regulatory element", "promoter", "terminator" and "operably connected" have their usual meaning in the art (as further described herein); and in which said "further elements" present in the genetic constructs may for example be 3'- or 5'-UTR sequences, leader sequences, selection markers, expression markers/reporter genes, and/or elements that may facilitate or increase (the efficiency of) transformation or integration. These and other suitable elements for such genetic constructs will be clear to the skilled person, and may for instance depend upon the type of construct used, the intended host cell or host organism; the manner in which the nucleotide sequences of the invention of interest are to be expressed (e.g. via constitutive, transient or inducible expression); and/or the transformation technique to be used. For example, regulatory sequences, promoters and terminators known per se for the expression and production of antibodies and antibody fragments (including but not limited to (single) domain antibodies and ScFv fragments) may be used in an essentially analogous manner.

Preferably, in the genetic constructs of the invention, said at least one nucleic acid of the invention and said regulatory elements, and optionally said one or more further elements, are "operably linked" to each other, by which is generally meant that they are in a functional relationship with each other. For instance, a promoter is considered "operably linked" to a coding sequence if said promoter is able to initiate or otherwise control/regulate the transcription and/or the expression of a coding sequence (in which said coding sequence should be understood as being "under the control of" said promoter). Generally, when two nucleotide sequences are operably linked, they will be in the same orientation and usually also in the same reading frame. They will usually also be essentially contiguous, although this may also not be required.

Preferably, the regulatory and further elements of the genetic constructs of the invention are such that they are capable of providing their intended biological function in the intended host cell or host organism.

For instance, a promoter, enhancer or terminator should be "operable" in the intended host cell or host organism, by which is meant that (for example) said promoter should be capable of initiating or otherwise controlling/regulating the transcription and/or the expression of a nucleotide sequence—e.g. a coding sequence—to which it is operably linked (as defined herein).

Some particularly preferred promoters include, but are not limited to, promoters known per se for the expression in the host cells mentioned herein; and in particular promoters for the expression in the bacterial cells, such as those mentioned herein and/or those used in the Examples.

A selection marker should be such that it allows—i.e. under appropriate selection conditions—host cells and/or host organisms that have been (successfully) transformed with the nucleotide sequence of the invention to be distinguished from host cells/organisms that have not been (successfully) transformed. Some preferred, but non-limiting examples of such markers are genes that provide resistance against antibiotics (such as kanamycin or ampicillin), genes that provide for temperature resistance, or genes that allow the host cell or host organism to be maintained in the absence of certain factors, compounds and/or (food) components in the medium that are essential for survival of the non-transformed cells or organisms.

A leader sequence should be such that—in the intended host cell or host organism—it allows for the desired post-translational modifications and/or such that it directs the transcribed mRNA to a desired part or organelle of a cell. A leader sequence may also allow for secretion of the expression product from said cell. As such, the leader sequence may be any pro-, pre-, or prepro-sequence operable in the host cell or host organism. Leader sequences may not be required for expression in a bacterial cell. For example, leader sequences known per se for the expression and production of antibodies and antibody fragments (including but not limited to single domain antibodies and ScFv fragments) may be used in an essentially analogous manner.

An expression marker or reporter gene should be such that—in the host cell or host organism—it allows for detection of the expression of (a gene or nucleotide sequence present on) the genetic construct. An expression marker may optionally also allow for the localisation of the expressed product, e.g. in a specific part or organelle of a cell and/or in (a) specific cell(s), tissue(s), organ(s) or part(s) of a multicellular organism. Such reporter genes may also be expressed as a protein fusion with the amino acid sequence of the invention. Some preferred, but non-limiting examples include fluorescent proteins such as GFP.

Some preferred, but non-limiting examples of suitable promoters, terminator and further elements include those that can be used for the expression in the host cells mentioned herein; and in particular those that are suitable for expression in bacterial cells, such as those mentioned herein and/or those used in the Examples below. For some (further) non-limiting examples of the promoters, selection markers, leader sequences, expression markers and further elements that may be present/used in the genetic constructs of the invention—such as terminators, transcriptional and/or translational enhancers and/or integration factors—reference is made to the general handbooks such as Sambrook et al. and Ausubel et al. mentioned above, as well as to the examples that are given in WO 95/07463, WO 96/23810, WO 95/07463, WO 95/21191, WO 97/11094, WO 97/42320, WO 98/06737, WO 98/21355, U.S. Pat. No. 7,207,410, U.S. Pat. No. 5,693,492 and EP 1 085 089. Other examples will be clear to the skilled person. Reference is also made to the general background art cited above and the further references cited herein.

The genetic constructs of the invention may generally be provided by suitably linking the nucleotide sequence(s) of the invention to the one or more further elements described above, for example using the techniques described in the general handbooks such as Sambrook et al. and Ausubel et al., mentioned above.

Often, the genetic constructs of the invention will be obtained by inserting a nucleotide sequence of the invention in a suitable (expression) vector known per se. Some preferred, but non-limiting examples of suitable expression vectors are those used in the Examples below, as well as those mentioned herein.

The nucleic acids of the invention and/or the genetic constructs of the invention may be used to transform a host cell or host organism, i.e. for expression and/or production of the amino acid sequence, NANOBODY or polypeptide of the invention. Suitable hosts or host cells will be clear to the skilled person, and may for example be any suitable fungal, prokaryotic or eukaryotic cell or cell line or any suitable fungal, prokaryotic or eukaryotic organism, for example:

a bacterial strain, including but not limited to gram-negative strains such as strains of *Escherichia coli*; of *Proteus*, for example of *Proteus mirabilis*; of *Pseudomonas*, for example of *Pseudomonas fluorescens*; and gram-positive strains such as strains of *Bacillus*, for example of *Bacillus subtilis* or of *Bacillus brevis*; of *Streptomyces*, for example of *Streptomyces lividans*; of *Staphylococcus*, for example of *Staphylococcus carnosus*; and of *Lactococcus*, for example of *Lactococcus lactis*;

a fungal cell, including but not limited to cells from species of *Trichoderma*, for example from *Trichoderma reesei*; of *Neurospora*, for example from *Neurospora crassa*; of *Sordaria*, for example from *Sordaria macrospora*; of *Aspergillus*, for example from *Aspergillus niger* or from *Aspergillus sojae*; or from other filamentous fungi;

a yeast cell, including but not limited to cells from species of *Saccharomyces*, for example of *Saccharomyces cerevisiae*; of *Schizosaccharomyces*, for example of *Schizosaccharomyces pombe*; of *Pichia*, for example of *Pichia pastoris* or of *Pichia methanolica*; of *Hansenula*, for example of *Hansenula polymorpha*; of *Kluyveromyces*, for example of *Kluyveromyces lactis*; of *Arxula*, for example of *Arxula adeninivorans*; of *Yarrowia*, for example of *Yarrowia lipolytica*;

an amphibian cell or cell line, such as *Xenopus* oocytes;

an insect-derived cell or cell line, such as cells/cell lines derived from lepidoptera, including but not limited to *Spodoptera* SF9 and Sf21 cells or cells/cell lines derived from *Drosophila*, such as Schneider and Kc cells;

a plant or plant cell, for example in tobacco plants; and/or a mammalian cell or cell line, for example a cell or cell line derived from a human, a cell or a cell line from mammals including but not limited to CHO-cells, BHK-cells (for example BHK-21 cells) and human cells or cell lines such as HeLa, COS (for example COS-7) and PER.C6 cells;

as well as all other hosts or host cells known per se for the expression and production of antibodies and antibody fragments (including but not limited to (single) domain antibodies and ScFv fragments), which will be clear to the skilled person. Reference is also made to the general background art cited hereinabove, as well as to for example WO 94/29457; WO 96/34103; WO 99/42077; Frenken et al., (1998), supra; Riechmann and Muyldermans, (1999), supra; van der Linden, (2000), supra; Thomassen et al., (2002), supra; Joosten et al., (2003), supra; Joosten et al., (2005), supra; and the further references cited herein.

The amino acid sequences, NANOBODIES and polypeptides of the invention can also be introduced and expressed in one or more cells, tissues or organs of a multicellular organism, for example for prophylactic and/or therapeutic purposes (e.g. as a gene therapy). For this purpose, the nucleotide sequences of the invention may be introduced into the cells or tissues in any suitable way, for example as such (e.g. using liposomes) or after they have been inserted into a suitable gene therapy vector (for example derived from retroviruses such as adenovirus, or parvoviruses such as adeno-associated virus). As will also be clear to the skilled person, such gene therapy may be performed in vivo and/or in situ in the body of a patient by administering a nucleic acid of the invention or a suitable gene therapy vector encoding the same to the patient or to specific cells or a specific tissue or organ of the patient; or suitable cells (often taken from the body of the patient to be treated, such as explanted lymphocytes, bone marrow aspirates or tissue biopsies) may be treated in vitro with a nucleotide sequence of the invention and then be suitably (re-)introduced into the body of the patient. All this can be performed using gene therapy vectors, techniques and delivery systems which are well known to the skilled person, and for example described in Culver, K. W., "Gene Therapy", 1994, p. xii, Mary Ann Liebert, Inc., Publishers, New York, N.Y.); Giordano, Nature F Medicine 2 (1996), 534-539; Schaper, Circ. Res. 79 (1996), 911-919; Anderson, Science 256 (1992), 808-813; Verma, Nature 389 (1994), 239; Isner, Lancet 348 (1996), 370-374; Muhlhauser, Circ. Res. 77 (1995), 1077-1086; Onodera, Blood 91; (1998), 30-36; Verma, Gene Ther. 5 (1998), 692-699; Nabel, Ann. N.Y. Acad. Sci.: 811 (1997), 289-292; Verzeletti, Hum. Gene Ther. 9 (1998), 2243-51; Wang, Nature Medicine 2 (1996), 714-716; WO 94/29469; WO 97/00957, U.S. Pat. No. 5,580,859; US 5,5895466; or Schaper, Current Opinion in Biotechnology 7 (1996), 635-640. For example, in situ expression of ScFv fragments (Afanasieva et al., Gene Ther., 10, 1850-1859 (2003)) and of diabodies (Blanco et al., J. Immunol, 171, 1070-1077 (2003)) has been described in the art.

For expression of the NANOBODIES in a cell, they may also be expressed as so-called "intrabodies", as for example described in WO 94/02610, WO 95/22618 and U.S. Pat. No. 7,004,940; WO 03/014960; in Cattaneo, A. & Biocca, S. (1997) Intracellular Antibodies: Development and Applications. Landes and Springer-Verlag; and in Kontermann, Methods 34, (2004), 163-170.

The amino acid sequences, NANOBODIES and polypeptides of the invention can for example also be produced in the milk of transgenic mammals, for example in the milk of rabbits, cows, goats or sheep (see for example U.S. Pat. No. 6,741,957, U.S. Pat. No. 6,304,489 and U.S. Pat. No. 6,849,992 for general techniques for introducing transgenes into mammals), in plants or parts of plants including but not limited to their leaves, flowers, fruits, seed, roots or tubers (for example in tobacco, maize, soybean or alfalfa) or in for example pupae of the silkworm *Bombix mori*.

Furthermore, the amino acid sequences, NANOBODIES and polypeptides of the invention can also be expressed and/or produced in cell-free expression systems, and suitable examples of such systems will be clear to the skilled person. Some preferred, but non-limiting examples include expression in the wheat germ system; in rabbit reticulocyte lysates; or in the *E. coli* Zubay system.

As mentioned above, one of the advantages of the use of NANOBODIES is that the polypeptides based thereon can be prepared through expression in a suitable bacterial system, and suitable bacterial expression systems, vectors, host cells, regulatory elements, etc., will be clear to the skilled person, for example from the references cited above. It should however be noted that the invention in its broadest sense is not limited to expression in bacterial systems.

Preferably, in the invention, an (in vivo or in vitro) expression system, such as a bacterial expression system, is used that provides the polypeptides of the invention in a form that is suitable for pharmaceutical use, and such expression systems will again be clear to the skilled person. As also will be clear to the skilled person, polypeptides of the invention suitable for pharmaceutical use can be prepared using techniques for peptide synthesis.

For production on industrial scale, preferred heterologous hosts for the (industrial) production of NANOBODIES or NANOBODY-containing protein therapeutics include strains of *E. coli, Pichia pastoris, S. cerevisiae* that are suitable for large scale expression/production/fermentation, and in particular for large scale pharmaceutical (i.e. GMP grade) expression/production/fermentation. Suitable examples of such strains will be clear to the skilled person. Such strains and production/expression systems are also made available by companies such as Biovitrum (Uppsala, Sweden).

Alternatively, mammalian cell lines, in particular Chinese hamster ovary (CHO) cells, can be used for large scale expression/production/fermentation, and in particular for large scale pharmaceutical expression/production/fermentation. Again, such expression/production systems are also made available by some of the companies mentioned above.

The choice of the specific expression system would depend in part on the requirement for certain post-translational modifications, more specifically glycosylation. The production of a NANOBODY-containing recombinant protein for which glycosylation is desired or required would necessitate the use of mammalian expression hosts that have the ability to glycosylate the expressed protein. In this respect, it will be clear to the skilled person that the glycosylation pattern obtained (i.e. the kind, number and position of residues attached) will depend on the cell or cell line that is used for the expression. Preferably, either a human cell or cell line is used (i.e. leading to a protein that essentially has a human glycosylation pattern) or another mammalian cell line is used that can provide a glycosylation pattern that is essentially and/or functionally the same as human glycosylation or at least mimics human glycosylation. Generally, prokaryotic hosts such as *E. coli* do not have the ability to glycosylate proteins, and the use of lower eukaryotes such as yeast usually leads to a glycosylation pattern that differs from human glycosylation. Nevertheless, it should be understood that all the foregoing host cells and expression systems can be used in the invention, depending on the desired amino acid sequence, NANOBODY or polypeptide to be obtained.

Thus, according to one non-limiting aspect of the invention, the amino acid sequence, NANOBODY or polypeptide of the invention is glycosylated. According to another non-limiting aspect of the invention, the amino acid sequence, NANOBODY or polypeptide of the invention is non-glycosylated.

According to one preferred, but non-limiting aspect of the invention, the amino acid sequence, NANOBODY or polypeptide of the invention is produced in a bacterial cell, in particular a bacterial cell suitable for large scale pharmaceutical production, such as cells of the strains mentioned above.

According to another preferred, but non-limiting aspect of the invention, the amino acid sequence, NANOBODY or polypeptide of the invention is produced in a yeast cell, in particular a yeast cell suitable for large scale pharmaceutical production, such as cells of the species mentioned above.

According to yet another preferred, but non-limiting aspect of the invention, the amino acid sequence, NANOBODY or polypeptide of the invention is produced in a mammalian cell, in particular in a human cell or in a cell of a human cell line, and more in particular in a human cell or in a cell of a human cell line that is suitable for large scale pharmaceutical production, such as the cell lines mentioned hereinabove.

When expression in a host cell is used to produce the amino acid sequences, NANOBODIES and the polypeptides of the invention, the amino acid sequences, NANOBODIES and polypeptides of the invention can be produced either intracellullarly (e.g. in the cytosol, in the periplasma or in inclusion bodies) and then isolated from the host cells and optionally further purified; or can be produced extracellularly (e.g. in the medium in which the host cells are cultured) and then isolated from the culture medium and optionally further purified. When eukaryotic host cells are used, extracellular production is usually preferred since this considerably facilitates the further isolation and downstream processing of the NANOBODIES and proteins obtained. Bacterial cells such as the strains of $E.$ $coli$ mentioned above normally do not secrete proteins extracellularly, except for a few classes of proteins such as toxins and hemolysin, and secretory production in $E.$ $coli$ refers to the translocation of proteins across the inner membrane to the periplasmic space. Periplasmic production provides several advantages over cytosolic production. For example, the N-terminal amino acid sequence of the secreted product can be identical to the natural gene product after cleavage of the secretion signal sequence by a specific signal peptidase. Also, there appears to be much less protease activity in the periplasm than in the cytoplasm. In addition, protein purification is simpler due to fewer contaminating proteins in the periplasm. Another advantage is that correct disulfide bonds may form because the periplasm provides a more oxidative environment than the cytoplasm. Proteins overexpressed in $E.$ $coli$ are often found in insoluble aggregates, so-called inclusion bodies. These inclusion bodies may be located in the cytosol or in the periplasm; the recovery of biologically active proteins from these inclusion bodies requires a denaturation/refolding process. Many recombinant proteins, including therapeutic proteins, are recovered from inclusion bodies. Alternatively, as will be clear to the skilled person, recombinant strains of bacteria that have been genetically modified so as to secrete a desired protein, and in particular an amino acid sequence, NANOBODY or a polypeptide of the invention, can be used.

Thus, according to one non-limiting aspect of the invention, the amino acid sequence, NANOBODY or polypeptide of the invention is an amino acid sequence, NANOBODY or polypeptide that has been produced intracellularly and that has been isolated from the host cell, and in particular from a bacterial cell or from an inclusion body in a bacterial cell. According to another non-limiting aspect of the invention, the amino acid sequence, NANOBODY or polypeptide of the invention is an amino acid sequence, NANOBODY or polypeptide that has been produced extracellularly, and that has been isolated from the medium in which the host cell is cultivated.

Some preferred, but non-limiting promoters for use with these host cells include, for expression in $E.$ $coli$: lac promoter (and derivatives thereof such as the lacUV5 promoter); arabinose promoter; left- (PL) and rightward (PR) promoter of phage lambda; promoter of the trp operon; hybrid lac/trp promoters (tac and trc); T7-promoter (more specifically that of T7-phage gene 10) and other T-phage promoters; promoter of the Tn10 tetracycline resistance gene; engineered variants of the above promoters that include one or more copies of an extraneous regulatory operator sequence; for expression in $S.$ $cerevisiae$: constitutive: ADH1 (alcohol dehydrogenase 1), ENO (enolase), CYC1 (cytochrome c iso-1), GAPDH (glyceraldehydes-3-phosphate dehydrogenase), PGK1 (phosphoglycerate kinase), PYK1 (pyruvate kinase); regulated: GAL1,10,7 (galactose metabolic enzymes), ADH2 (alcohol dehydrogenase 2), PHO5 (acid phosphatase), CUP1 (copper metallothionein); heterologous: CaMV (cauliflower mosaic virus 35S promoter);

for expression in *Pichia pastoris*: the AOX1 promoter (alcohol oxidase I);

for expression in mammalian cells: human cytomegalovirus (hCMV) immediate early enhancer/promoter; human cytomegalovirus (hCMV) immediate early promoter variant that contains two tetracycline operator sequences such that the promoter can be regulated by the Tet repressor; Herpes Simplex Virus thymidine kinase (TK) promoter; Rous Sarcoma Virus long terminal repeat (RSV LTR) enhancer/promoter; elongation factor 1α (hEF-1α) promoter from human, chimpanzee, mouse or rat; the SV40 early promoter; HIV-1 long terminal repeat promoter; β-actin promoter;

Some preferred, but non-limiting vectors for use with these host cells include:

vectors for expression in mammalian cells: pMAMneo (Clontech), pcDNA3 (Invitrogen), pMC1neo (Stratagene), pSG5 (Stratagene), EBO-pSV2-neo (ATCC 37593), pBPV-1 (8-2) (ATCC 37110), pdBPV-MMT-neo (342-12) (ATCC 37224), pRSVgpt (ATCC37199), pRSVneo (ATCC37198), pSV2-dhfr (ATCC 37146), pUCTag (ATCC 37460) and 1ZD35 (ATCC 37565), as well as viral-based expression systems, such as those based on adenovirus;

vectors for expression in bacterial cells: pET vectors (Novagen) and pQE vectors (Qiagen);

vectors for expression in yeast or other fungal cells: pYES2 (Invitrogen) and *Pichia* expression vectors (Invitrogen);

vectors for expression in insect cells: pBlueBacII (Invitrogen) and other baculovirus vectors vectors for expression in plants or plant cells: for example vectors based on cauliflower mosaic virus or tobacco mosaic virus, suitable strains of *Agrobacterium*, or Ti-plasmid based vectors.

Some preferred, but non-limiting secretory sequences for use with these host cells include:

- for use in bacterial cells such as *E. coli*: PelB, Bla, OmpA, OmpC, OmpF, OmpT, StII, PhoA, PhoE, MalE, Lpp, LamB, and the like; TAT signal peptide, hemolysin C-terminal secretion signal;
- for use in yeast: α-mating factor prepro-sequence, phosphatase (pho1), invertase (Suc), etc.;
- for use in mammalian cells: indigenous signal in case the target protein is of eukaryotic origin; murine Ig K-chain V-J2-C signal peptide; etc.

Suitable techniques for transforming a host or host cell of the invention will be clear to the skilled person and may depend on the intended host cell/host organism and the genetic construct to be used. Reference is again made to the handbooks and patent applications mentioned above.

After transformation, a step for detecting and selecting those host cells or host organisms that have been successfully transformed with the nucleotide sequence/genetic construct of the invention may be performed. This may for instance be a selection step based on a selectable marker present in the genetic construct of the invention or a step involving the detection of the amino acid sequence of the invention, e.g. using specific antibodies.

The transformed host cell (which may be in the form or a stable cell line) or host organisms (which may be in the form of a stable mutant line or strain) form further aspects of the present invention.

Preferably, these host cells or host organisms are such that they express, or are (at least) capable of expressing (e.g. under suitable conditions), an amino acid sequence, NANOBODY or polypeptide of the invention (and in case of a host organism: in at least one cell, part, tissue or organ thereof). The invention also includes further generations, progeny and/or offspring of the host cell or host organism of the invention, that may for instance be obtained by cell division or by sexual or asexual reproduction.

To produce/obtain expression of the amino acid sequences of the invention, the transformed host cell or transformed host organism may generally be kept, maintained and/or cultured under conditions such that the (desired) amino acid sequence, NANOBODY or polypeptide of the invention is expressed/produced. Suitable conditions will be clear to the skilled person and will usually depend upon the host cell/host organism used, as well as on the regulatory elements that control the expression of the (relevant) nucleotide sequence of the invention. Again, reference is made to the handbooks and patent applications mentioned above in the paragraphs on the genetic constructs of the invention.

Generally, suitable conditions may include the use of a suitable medium, the presence of a suitable source of food and/or suitable nutrients, the use of a suitable temperature, and optionally the presence of a suitable inducing factor or compound (e.g. when the nucleotide sequences of the invention are under the control of an inducible promoter); all of which may be selected by the skilled person. Again, under such conditions, the amino acid sequences of the invention may be expressed in a constitutive manner, in a transient manner, or only when suitably induced.

It will also be clear to the skilled person that the amino acid sequence, NANOBODY or polypeptide of the invention may (first) be generated in an immature form (as mentioned above), which may then be subjected to post-translational modification, depending on the host cell/host organism used. Also, the amino acid sequence, NANOBODY or polypeptide of the invention may be glycosylated, again depending on the host cell/host organism used.

The amino acid sequence, NANOBODY or polypeptide of the invention may then be isolated from the host cell/host organism and/or from the medium in which said host cell or host organism was cultivated, using protein isolation and/or purification techniques known per se, such as (preparative) chromatography and/or electrophoresis techniques, differential precipitation techniques, affinity techniques (e.g. using a specific, cleavable amino acid sequence fused with the amino acid sequence, NANOBODY or polypeptide of the invention) and/or preparative immunological techniques (i.e. using antibodies against the amino acid sequence to be isolated).

Generally, for pharmaceutical use, the polypeptides of the invention may be formulated as a pharmaceutical preparation or compositions comprising at least one polypeptide of the invention and at least one pharmaceutically acceptable carrier, diluent or excipient and/or adjuvant, and optionally one or more further pharmaceutically active polypeptides and/or compounds. By means of non-limiting examples, such a formulation may be in a form suitable for oral administration, for parenteral administration (such as by intravenous, intramuscular or subcutaneous injection or intravenous infusion), for topical administration, for administration by inhalation, by a skin patch, by an implant, by a suppository, etc. Such suitable administration forms—which may be solid, semi-solid or liquid, depending on the manner of administration—as well as methods and carriers for use in the preparation thereof, will be clear to the skilled person, and are further described herein.

Thus, in a further aspect, the invention relates to a pharmaceutical composition that contains at least one amino acid of the invention, at least one NANOBODY of the invention or at least one polypeptide of the invention and at least one suitable carrier, diluent or excipient (i.e. suitable for pharmaceutical use), and optionally one or more further active substances.

Generally, the amino acid sequences, NANOBODIES and polypeptides of the invention can be formulated and administered in any suitable manner known per se, for which reference is for example made to the general background art cited above (and in particular to WO 04/041862, WO 04/041863, WO 04/041865, WO 04/041867 and WO 08/020079) as well as to the standard handbooks, such as Remington's Pharmaceutical Sciences, 18$^{th}$ Ed., Mack Publishing Company, USA (1990) or Remington, the Science and Practice of Pharmacy, 21st Edition, Lippincott Williams and Wilkins (2005); or the Handbook of Therapeutic Antibodies (S. Dubel, Ed.), Wiley, Weinheim, 2007 (see for example pages 252-255).

For example, the amino acid sequences, NANOBODIES and polypeptides of the invention may be formulated and administered in any manner known per se for conventional antibodies and antibody fragments (including ScFv's and diabodies) and other pharmaceutically active proteins. Such formulations and methods for preparing the same will be clear to the skilled person, and for example include preparations suitable for parenteral administration (for example intravenous, intraperitoneal, subcutaneous, intramuscular, intraluminal, intra-arterial or intrathecal administration) or for topical (i.e. transdermal or intradermal) administration.

Preparations for parenteral administration may for example be sterile solutions, suspensions, dispersions or emulsions that are suitable for infusion or injection. Suitable carriers or diluents for such preparations for example include, without limitation, sterile water and aqueous buffers and solutions such as physiological phosphate-buffered saline, Ringer's solutions, dextrose solution, and Hank's solution; water oils; glycerol; ethanol; glycols such as propylene glycol or as well as mineral oils, animal oils and vegetable oils, for example peanut oil, soybean oil, as well as suitable mixtures thereof. Usually, aqueous solutions or suspensions will be preferred.

The amino acid sequences, NANOBODIES and polypeptides of the invention can also be administered using gene therapy methods of delivery. See, e.g., U.S. Pat. No. 5,399, 346, which is incorporated by reference in its entirety. Using a gene therapy method of delivery, primary cells transfected with the gene encoding an amino acid sequence, NANOBODY or polypeptide of the invention can additionally be transfected with tissue specific promoters to target specific organs, tissue, grafts, tumors, or cells and can additionally be transfected with signal and stabilization sequences for subcellularly localized expression.

Thus, the amino acid sequences, NANOBODIES and polypeptides of the invention may be systemically administered, e.g., orally, in combination with a pharmaceutically acceptable vehicle such as an inert diluent or an assimilable edible carrier. They may be enclosed in hard or soft shell gelatin capsules, may be compressed into tablets, or may be incorporated directly with the food of the patient's diet. For oral therapeutic administration, the amino acid sequences, NANOBODIES and polypeptides of the invention may be combined with one or more excipients and used in the form of ingestible tablets, buccal tablets, troches, capsules, elixirs, suspensions, syrups, wafers, and the like. Such compositions and preparations should contain at least 0.1% of the amino acid sequence, NANOBODY or polypeptide of the invention. Their percentage in the compositions and preparations may, of course, be varied and may conveniently be between about 2 to about 60% of the weight of a given unit dosage form. The amount of the amino acid sequence, NANOBODY or polypeptide of the invention in such therapeutically useful compositions is such that an effective dosage level will be obtained.

The tablets, troches, pills, capsules, and the like may also contain the following: binders such as gum tragacanth, acacia, corn starch or gelatin; excipients such as dicalcium phosphate; a disintegrating agent such as corn starch, potato starch, alginic acid and the like; a lubricant such as magnesium stearate; and a sweetening agent such as sucrose, fructose, lactose or aspartame or a flavoring agent such as peppermint, oil of wintergreen, or cherry flavoring may be added. When the unit dosage form is a capsule, it may contain, in addition to materials of the above type, a liquid carrier, such as a vegetable oil or a polyethylene glycol. Various other materials may be present as coatings or to otherwise modify the physical form of the solid unit dosage form. For instance, tablets, pills, or capsules may be coated with gelatin, wax, shellac or sugar and the like. A syrup or elixir may contain the amino acid sequences, NANOBODIES and polypeptides of the invention, sucrose or fructose as a sweetening agent, methyl and propylparabens as preservatives, a dye and flavoring such as cherry or orange flavor. Of course, any material used in preparing any unit dosage form should be pharmaceutically acceptable and substantially non-toxic in the amounts employed. In addition, the amino acid sequences, NANOBODIES and polypeptides of the invention may be incorporated into sustained-release preparations and devices.

Preparations and formulations for oral administration may also be provided with an enteric coating that will allow the constructs of the invention to resist the gastric environment and pass into the intestines. More generally, preparations and formulations for oral administration may be suitably formulated for delivery into any desired part of the gastrointestinal tract. In addition, suitable suppositories may be used for delivery into the gastrointestinal tract.

The amino acid sequences, NANOBODIES and polypeptides of the invention may also be administered intravenously or intraperitoneally by infusion or injection. Solutions of the amino acid sequences, NANOBODIES and polypeptides of the invention or their salts can be prepared in water, optionally mixed with a nontoxic surfactant. Dispersions can also be prepared in glycerol, liquid polyethylene glycols, triacetin, and mixtures thereof and in oils. Under ordinary conditions of storage and use, these preparations contain a preservative to prevent the growth of microorganisms.

The pharmaceutical dosage forms suitable for injection or infusion can include sterile aqueous solutions or dispersions or sterile powders comprising the active ingredient which are adapted for the extemporaneous preparation of sterile injectable or infusible solutions or dispersions, optionally encapsulated in liposomes. In all cases, the ultimate dosage form must be sterile, fluid and stable under the conditions of manufacture and storage. The liquid carrier or vehicle can be a solvent or liquid dispersion medium comprising, for example, water, ethanol, a polyol (for example, glycerol, propylene glycol, liquid polyethylene glycols, and the like), vegetable oils, nontoxic glyceryl esters, and suitable mixtures thereof. The proper fluidity can be maintained, for example, by the formation of liposomes, by the maintenance of the required particle size in the case of dispersions or by the use of surfactants. The prevention of the action of microorganisms can be brought about by various antibacterial and antifungal agents, for example, parabens, chlorobutanol, phenol, sorbic acid, thimerosal, and the like. In many cases, it will be preferable to include isotonic agents, for example, sugars, buffers or sodium chloride. Prolonged absorption of the injectable compositions can be brought about by the use in the compositions of agents delaying absorption, for example, aluminum monostearate and gelatin.

Sterile injectable solutions are prepared by incorporating the amino acid sequences, NANOBODIES and polypeptides of the invention in the required amount in the appropriate solvent with various of the other ingredients enumerated above, as required, followed by filter sterilization. In the case of sterile powders for the preparation of sterile injectable solutions, the preferred methods of preparation are vacuum drying and the freeze drying techniques, which yield a powder of the active ingredient plus any additional desired ingredient present in the previously sterile-filtered solutions.

For topical administration, the amino acid sequences, NANOBODIES and polypeptides of the invention may be applied in pure form, i.e., when they are liquids. However, it will generally be desirable to administer them to the skin as compositions or formulations, in combination with a dermatologically acceptable carrier, which may be a solid or a liquid.

Useful solid carriers include finely divided solids such as talc, clay, microcrystalline cellulose, silica, alumina and the like. Useful liquid carriers include water, hydroxyalkyls or glycols or water-alcohol/glycol blends, in which the amino acid sequences, NANOBODIES and polypeptides of the invention can be dissolved or dispersed at effective levels, optionally with the aid of non-toxic surfactants. Adjuvants such as fragrances and additional antimicrobial agents can be added to optimize the properties for a given use. The resultant liquid compositions can be applied from absorbent pads, used to impregnate bandages and other dressings, or sprayed onto the affected area using pump-type or aerosol sprayers.

Thickeners such as synthetic polymers, fatty acids, fatty acid salts and esters, fatty alcohols, modified celluloses or modified mineral materials can also be employed with liquid carriers to form spreadable pastes, gels, ointments, soaps, and the like, for application directly to the skin of the user.

Examples of useful dermatological compositions which can be used to deliver the amino acid sequences, NANOBODIES and polypeptides of the invention to the skin are known to the art; for example, see Jacquet et al. (U.S. Pat. No. 4,608,392), Geria (U.S. Pat. No. 4,992,478), Smith et al. (U.S. Pat. No. 4,559,157) and Wortzman (U.S. Pat. No. 4,820,508).

Useful dosages of the amino acid sequences, NANOBODIES and polypeptides of the invention can be determined by comparing their in vitro activity, and in vivo activity in animal models. Methods for the extrapolation of effective dosages in mice, and other animals, to humans are known to the art; for example, see U.S. Pat. No. 4,938,949.

Generally, the concentration of the amino acid sequences, NANOBODIES and polypeptides of the invention in a liquid composition, such as a lotion, will be from about 0.1-25 wt-%, preferably from about 0.5-10 wt-%. The concentration in a semi-solid or solid composition such as a gel or a powder will be about 0.1-5 wt-%, preferably about 0.5-2.5 wt-%.

The amount of the amino acid sequences, NANOBODIES and polypeptides of the invention required for use in treatment will vary not only with the particular amino acid sequence, NANOBODY or polypeptide selected but also with the route of administration, the nature of the condition being treated and the age and condition of the patient and will be ultimately at the discretion of the attendant physician or clinician. Also the dosage of the amino acid sequences, NANOBODIES and polypeptides of the invention varies depending on the target cell, tumor, tissue, graft, or organ.

The desired dose may conveniently be presented in a single dose or as divided doses administered at appropriate intervals, for example, as two, three, four or more sub-doses per day. The sub-dose itself may be further divided, e.g., into a number of discrete loosely spaced administrations; such as multiple inhalations from an insufflator or by application of a plurality of drops into the eye.

An administration regimen could include long-term, daily treatment. By "long-term" is meant at least two weeks and preferably, several weeks, months, or years of duration. Necessary modifications in this dosage range may be determined by one of ordinary skill in the art using only routine experimentation given the teachings herein. See Remington's Pharmaceutical Sciences (Martin, E. W., ed. 4), Mack Publishing Co., Easton, Pa. The dosage can also be adjusted by the individual physician in the event of any complication.

In another aspect, the invention relates to a method for the prevention and/or treatment of at least one bone disease or disorder, said method comprising administering, to a subject in need thereof, a pharmaceutically active amount of an amino acid sequence of the invention, of a NANOBODY of the invention, of a polypeptide of the invention, and/or of a pharmaceutical composition comprising the same.

In the context of the present invention, the term "prevention and/or treatment" not only comprises preventing and/or treating the disease, but also generally comprises preventing the onset of the disease, slowing or reversing the progress of disease, preventing or slowing the onset of one or more symptoms associated with the disease, reducing and/or alleviating one or more symptoms associated with the disease, reducing the severity and/or the duration of the disease and/or of any symptoms associated therewith and/or preventing a further increase in the severity of the disease and/or of any symptoms associated therewith, preventing, reducing or reversing any physiological damage caused by the disease, and generally any pharmacological action that is beneficial to the patient being treated.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention relates to a method for the prevention and/or treatment of at least one disease or disorder that is associated with RANK-L, with its biological or pharmacological activity, and/or with the biological pathways or signalling in which RANK-L is involved, said method comprising administering, to a subject in need thereof, a pharmaceutically active amount of an amino acid sequence of the invention, of a NANOBODY of the invention, of a polypeptide of the invention, and/or of a pharmaceutical composition comprising the same. In particular, the invention relates to a method for the prevention and/or treatment of at least one disease or disorder that can be treated by modulating RANK-L, its biological or pharmacological activity, and/or the biological pathways or signalling in which RANK-L is involved, said method comprising administering, to a subject in need thereof, a pharmaceutically active amount of an amino acid sequence of the invention, of a NANOBODY of the invention, of a polypeptide of the invention, and/or of a pharmaceutical composition comprising the same. In particular, said pharmaceutically effective amount may be an amount that is sufficient to modulate RANK-L, its biological or pharmacological activity, and/or the biological pathways or signalling in which RANK-L is involved; and/or an amount that provides a level of the amino acid sequence of the invention, of a NANOBODY of the invention, of a polypeptide of the invention in the circulation that is sufficient to modulate RANK-L, its biological or pharmacological activity, and/or the biological pathways or signalling in which RANK-L is involved.

The invention furthermore relates to a method for the prevention and/or treatment of at least one disease or disorder that can be prevented and/or treated by administering an amino acid sequence of the invention, a NANOBODY of the invention or a polypeptide of the invention to a patient, said method comprising administering, to a subject in need thereof, a pharmaceutically active amount of an amino acid sequence of the invention, of a NANOBODY of the invention, of a polypeptide of the invention, and/or of a pharmaceutical composition comprising the same.

More in particular, the invention relates to a method for the prevention and/or treatment of at least one disease or disorder chosen from the group consisting of the diseases and disorders listed herein, said method comprising administering, to a subject in need thereof, a pharmaceutically active amount of an amino acid sequence of the invention, of a NANOBODY of the invention, of a polypeptide of the invention, and/or of a pharmaceutical composition comprising the same.

In another aspect, the invention relates to a method for immunotherapy, and in particular for passive immunotherapy, which method comprises administering, to a subject suffering from or at risk of the diseases and disorders mentioned herein, a pharmaceutically active amount of an amino acid sequence of the invention, of a NANOBODY of the invention, of a polypeptide of the invention, and/or of a pharmaceutical composition comprising the same.

In the above methods, the amino acid sequences, NANOBODIES and/or polypeptides of the invention and/or the compositions comprising the same can be administered in any suitable manner, depending on the specific pharmaceutical formulation or composition to be used. Thus, the amino acid sequences, NANOBODIES and/or polypeptides of the invention and/or the compositions comprising the same can for example be administered orally, intraperitoneally (e.g. intravenously, subcutaneously, intramuscularly, or via any other route of administration that circumvents the gastrointestinal tract), intranasally, transdermally, topically, by means of a suppository, by inhalation, again depending on the specific pharmaceutical formulation or composition to be used. The clinician will be able to select a suitable route of administration and a suitable pharmaceutical formulation or composition to be used in such administration, depending on the disease or disorder to be prevented or treated and other factors well known to the clinician.

The amino acid sequences, NANOBODIES and/or polypeptides of the invention and/or the compositions comprising the same are administered according to a regime of treatment that is suitable for preventing and/or treating the disease or disorder to be prevented or treated. The clinician will generally be able to determine a suitable treatment regimen, depending on factors such as the disease or disorder to be prevented or treated, the severity of the disease to be treated and/or the severity of the symptoms thereof, the specific amino acid sequence, NANOBODY or polypeptide of the invention to be used, the specific route of administration and pharmaceutical formulation or composition to be used, the age, gender, weight, diet, general condition of the patient, and similar factors well known to the clinician.

Generally, the treatment regimen will comprise the administration of one or more amino acid sequences, NANOBODIES and/or polypeptides of the invention, or of one or more compositions comprising the same, in one or more pharmaceutically effective amounts or doses. The specific amount(s) or doses to administer can be determined by the clinician, again based on the factors cited above.

Generally, for the prevention and/or treatment of the diseases and disorders mentioned herein and depending on the specific disease or disorder to be treated, the potency of the specific amino acid sequence, NANOBODY and polypeptide of the invention to be used, the specific route of administration and the specific pharmaceutical formulation or composition used, the amino acid sequences, NANOBODIES and polypeptides of the invention will generally be administered in an amount between 1 gram and 0.01 microgram per kg body weight per day, preferably between 0.1 gram and 0.1 microgram per kg body weight per day, such as about 1, 10, 100 or 1000 microgram per kg body weight per day, either continuously (e.g. by infusion), as a single daily dose or as multiple divided doses during the day. The clinician will generally be able to determine a suitable daily dose, depending on the factors mentioned herein. It will also be clear that in specific cases, the clinician may choose to deviate from these amounts, for example on the basis of the factors cited above and his expert judgment. Generally, some guidance on the amounts to be administered can be obtained from the amounts usually administered for comparable conventional antibodies or antibody fragments against the same target administered via essentially the same route, taking into account however differences in affinity/avidity, efficacy, biodistribution, half-life and similar factors well known to the skilled person.

Usually, in the above method, a single amino acid sequence, NANOBODY or polypeptide of the invention will be used. It is however within the scope of the invention to use two or more amino acid sequences, NANOBODIES and/or polypeptides of the invention in combination.

The NANOBODIES, amino acid sequences and polypeptides of the invention may also be used in combination with one or more further pharmaceutically active compounds or principles, i.e. as a combined treatment regimen, which may or may not lead to a synergistic effect. Again, the clinician will be able to select such further compounds or principles, as well as a suitable combined treatment regimen, based on the factors cited above and his expert judgement.

In particular, the amino acid sequences, NANOBODIES and polypeptides of the invention may be used in combination with other pharmaceutically active compounds or principles that are or can be used for the prevention and/or treatment of the diseases and disorders cited herein, as a result of which a synergistic effect may or may not be obtained. Examples of such compounds and principles, as well as routes, methods and pharmaceutical formulations or compositions for administering them will be clear to the clinician.

In particular, the pharmaceutical composition of the invention may comprise one or more amino acid sequences, NANOBODIES and/or polypeptides of the invention and at least one additional therapeutic agent selected from a bone morphogenic factor, transforming growth factor-$\beta$ (TGF-$\beta$), an interleukin-1 (IL-1) inhibitor, IL-1ra, Kineret™, a TNF$\alpha$ inhibitor, a soluble TNF$\alpha$ receptor, Enbrel™, an anti-TNF$\alpha$ antibody, Remicade™, a D2E7 antibody, a parathyroid hormone, an analog of a parathyroid hormone, a parathyroid hormone related protein, an analog of a parathyroid hormone related protein, a prostaglandin, a bisphosphonate, an alendronate, fluoride, calcium, a non-steroidal anti-inflammatory drug (NSAID), a COX-2 inhibitor, Celebrex™, Vioxx™, an immunosuppressant, methotrexate, leflunomide, a serine protease inhibitor, a secretory leukocyte protease inhibitor (SLPI), an IL-6 inhibitor, an antibody or NANOBODY against IL-6, an IL-8 inhibitor, an antibody or NANOBODY against IL-8, an IL-18 inhibitor, an IL-18 binding protein, an antibody or NANOBODY against IL-18, an Interleukin-1 converting enzyme (ICE) modulator, a fibroblast growth factor (FGF), an FGF modulator, a PAF antagonist, a keratinocyte growth factor (KGF), a KGF-related molecule, a KGF modulator, a matrix metalloproteinase (MMP) modulator, a nitric oxide synthase (NOS) modulator, a modulator of glucocorticoid receptor, a modulator of glutamate receptor, a modulator of lipopolysaccharide (LPS) levels, a noradrenaline, a noradrenaline mimetic, and a noradrenaline modulator as described, for example, in US 2004/00335353

When two or more substances or principles are to be used as part of a combined treatment regimen, they can be administered via the same route of administration or via different routes of administration, at essentially the same time or at different times (e.g. essentially simultaneously, consecutively, or according to an alternating regime). When the substances or principles are to be administered simultaneously via the same route of administration, they may be administered as different pharmaceutical formulations or compositions or part of a combined pharmaceutical formulation or composition, as will be clear to the skilled person.

Also, when two or more active substances or principles are to be used as part of a combined treatment regimen, each of the substances or principles may be administered in the same amount and according to the same regimen as used when the compound or principle is used on its own, and such combined use may or may not lead to a synergistic effect. However, when the combined use of the two or more active substances or principles leads to a synergistic effect, it may also be possible to reduce the amount of one, more or all of the substances or principles to be administered, while still achieving the desired therapeutic action. This may for example be useful for avoiding, limiting or reducing any unwanted side-effects that are associated with the use of one or more of the substances or principles when they are used in their usual amounts, while still obtaining the desired pharmaceutical or therapeutic effect.

The effectiveness of the treatment regimen used according to the invention may be determined and/or followed in any manner known per se for the disease or disorder involved, as will be clear to the clinician. The clinician will also be able, where appropriate and on a case-by-case basis, to change or modify a particular treatment regimen, so as to achieve the desired therapeutic effect, to avoid, limit or reduce unwanted side-effects, and/or to achieve an appropriate balance between achieving the desired therapeutic effect on the one hand and avoiding, limiting or reducing undesired side effects on the other hand.

Generally, the treatment regimen will be followed until the desired therapeutic effect is achieved and/or for as long as the desired therapeutic effect is to be maintained. Again, this can be determined by the clinician.

In another aspect, the invention relates to the use of an amino acid sequence, NANOBODY or polypeptide of the invention in the preparation of a pharmaceutical composition for prevention and/or treatment of at least one bone disease or disorder; and/or for use in one or more of the methods of treatment mentioned herein.

The subject to be treated may be any warm-blooded animal, but is in particular a mammal, and more in particular a human being. As will be clear to the skilled person, the subject to be treated will in particular be a person suffering from, or at risk of, the diseases and disorders mentioned herein.

The invention also relates to the use of an amino acid sequence, NANOBODY or polypeptide of the invention in the preparation of a pharmaceutical composition for the prevention and/or treatment of at least one disease or disorder that can be prevented and/or treated by administering an amino acid sequence, NANOBODY or polypeptide of the invention to a patient.

More in particular, the invention relates to the use of an amino acid sequence, NANOBODY or polypeptide of the invention in the preparation of a pharmaceutical composition for the prevention and/or treatment of bone diseases and disorders, and in particular for the prevention and treatment of one or more of the diseases and disorders listed herein.

Again, in such a pharmaceutical composition, the one or more amino acid sequences, NANOBODIES or polypeptides of the invention may also be suitably combined with one or more other active principles, such as those mentioned herein.

Finally, although the use of the NANOBODIES of the invention (as defined herein) and of the polypeptides of the invention is much preferred, it will be clear that on the basis of the description herein, the skilled person will also be able to design and/or generate, in an analogous manner, other amino acid sequences and in particular (single) domain antibodies against RANK-L, as well as polypeptides comprising such (single) domain antibodies.

For example, it will also be clear to the skilled person that it may be possible to "graft" one or more of the CDR's mentioned above for the NANOBODIES of the invention onto such (single) domain antibodies or other protein scaffolds, including but not limited to human scaffolds or non-immunoglobulin scaffolds. Suitable scaffolds and techniques for such CDR grafting will be clear to the skilled person and are well known in the art, see for example U.S. Pat. No. 7,180,370, WO 01/27160, EP 0 605 522, EP 0 460 167, U.S. Pat. No. 7,054,297, Nicaise et al., Protein Science (2004), 13:1882-1891; Ewert et al., Methods, 2004 October; 34(2):184-199; Kettleborough et al., Protein Eng. 1991 October; 4(7): 773-783; O'Brien and Jones, Methods Mol. Biol. 2003: 207: 81-100; Skerra, J. Mol. Recognit. 2000: 13: 167-187, and Saerens et al., J. Mol. Biol. 2005 Sep. 23; 352(3):597-607, and the further references cited therein. For example, techniques known per se for grafting mouse or rat CDR's onto human frameworks and scaffolds can be used in an analogous manner to provide chimeric proteins comprising one or more of the CDR's of the NANOBODIES of the invention and one or more human framework regions or sequences.

It should also be noted that, when the NANOBODIES of the inventions contain one or more other CDR sequences than the preferred CDR sequences mentioned above, these CDR sequences can be obtained in any manner known per se, for example from NANOBODIES (preferred), $V_H$ domains from conventional antibodies (and in particular from human antibodies), heavy chain antibodies, conventional 4-chain antibodies (such as conventional human 4-chain antibodies) or other immunoglobulin sequences directed against RANK-L. Such immunoglobulin sequences directed against RANK-L can be generated in any manner known per se, as will be clear to the skilled person, i.e. by immunization with RANK-L or by screening a suitable library of immunoglobulin sequences with RANK-L, or any suitable combination thereof. Optionally, this may be followed by techniques such as random or site-directed mutagenesis and/or other techniques for affinity maturation known per se. Suitable techniques for generating such immunoglobulin sequences will be clear to the skilled person, and for example include the screening techniques reviewed by Hoogenboom, Nature Biotechnology, 23, 9, 1105-1116 (2005). Other techniques for generating immunoglobulins against a specified target include for example the Nanoclone technology (as for example described in the published US patent application 2006-0211088), so-called SLAM technology (as for example described in the European patent application 0 542 810), the use of transgenic mice expressing human immunoglobulins or the well-known hybridoma techniques (see for example Larrick et al, Biotechnology, Vol. 7, 1989, p. 934). All these techniques can be used to generate immunoglobulins against RANK-L, and the CDR's of such immunoglobulins can be used in the NANOBODIES of the invention, i.e. as outlined above. For example, the sequence of such a CDR can be determined, synthesized and/or isolated, and inserted into the sequence of a NANOBODY of the invention (e.g. so as to replace the corresponding native CDR), all using techniques known per se such as those described herein, or NANOBODIES of the invention containing such CDR's (or nucleic acids encoding the same) can be synthesized de novo, again using the techniques mentioned herein.

Further uses of the amino acid sequences, NANOBODIES, polypeptides, nucleic acids, genetic constructs and hosts and host cells of the invention will be clear to the skilled person based on the disclosure herein. For example, and without limitation, the amino acid sequences of the invention can be linked to a suitable carrier or solid support so as to provide a medium than can be used in a manner known per se to purify RANK-L from compositions and preparations comprising the same. Derivatives of the amino acid sequences of the invention that comprise a suitable detectable label can also be used as markers to determine (qualitatively or quantitatively) the presence of RANK-L in a composition or preparation or as a marker to selectively detect the presence of RANK-L on the surface of a cell or tissue (for example, in combination with suitable cell sorting techniques).

The invention will now be further described by means of the following non-limiting preferred aspects, examples and figures:

Preferred Aspects

1. Amino acid sequence that is directed against and/or that can specifically bind to RANK-L.
2. Amino acid sequence according to aspect 1, which is directed against and/or can specifically bind to the RANK receptor binding site on RANK-L.
3. Amino acid sequence according to any of aspects 1 or 2, which is directed against and/or can specifically bind to the intersubunit receptor-binding grooves on the RANK-L trimer.
4. Amino acid sequence according to any of aspects 1 to 3, which modulates binding of RANKL-L to RANK.
5. Amino acid sequence according to aspect 4, which inhibits and/or prevents binding of RANKL-L to RANK.
6. Amino acid sequence according to aspect 5, which inhibits and/or prevents binding of RANKL-L to RANK, while not reducing and/or inhibiting the RANK-L/OPG interaction.
7. Amino acid sequence according to any of aspects 1 to 6, which is an antagonist of RANK-L
8. Amino acid sequence according aspect 1, which is directed against and/or can specifically bind to the OPG binding site on RANK-L.
9. Amino acid sequence according aspects 1 or 8, which modulates binding of RANKL-L to OPG.
10. Amino acid sequence according to aspect 9, which inhibits and/or prevents the RANK/RANK-L interaction.
11. Amino acid sequence according to aspect 10, which is an antagonist of RANK-L.
12. Amino acid sequence according to aspect 8, which does not reduce or inhibit the RANK/RANK-L interaction.
13. Amino acid sequence according to aspect 12, which is an agonist of RANK-L.
14. Amino acid sequence according to aspect 1, which prevents and/or inhibits the formation of the RANK-L trimer.
15. Amino acid sequence according to aspect 1, which prevents and/or inhibits the differentiation and/or proliferation of osteoclasts.
16. Amino acid sequence according to aspect 1, which modulates bone remodelling.
17. Amino acid sequence according to any of aspects 1 to 16, which does not bind TRAIL.
18. Amino acid sequence according to any of aspects 1 to 17, which does not bind TNF-alpha.
19. Amino acid sequence according to any of aspects 1 to 18, which does not bind CD40 ligand.
20. Amino acid sequence according to any of aspects 1 to 19, which does not bind related TNF family members.
21. Amino acid sequence according to any of aspects 1 to 20, that is in essentially isolated form.
22. Amino acid sequence according to any of aspects 1 to 21, for administration to a subject, wherein said amino acid sequence does not naturally occur in said subject.
23. Amino acid sequence according to any of the preceding aspects, that can specifically bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.
24. Amino acid sequence according to any of the preceding aspects, that can specifically bind to RANK-L with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.
25. Amino acid sequence according to any of the preceding aspects, that can specifically bind to RANK-L with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
26. Amino acid sequence according to any of the preceding aspects, that can specifically bind to RANK-L with an affinity less than 500 nM, preferably less than 200 nM, more preferably less than 10 nM, such as less than 500 pM.
27. Amino acid sequence according to any of the preceding aspects, that is a naturally occurring amino acid sequence (from any suitable species) or a synthetic or semi-synthetic amino acid sequence.
28. Amino acid sequence according to any of the preceding aspects, that comprises an immunoglobulin fold or that under suitable conditions is capable of forming an immunoglobulin fold.
29. Amino acid sequence according to any of the preceding aspects, that essentially consists of 4 framework regions (FR1 to FR4 respectively) and 3 complementarity determining regions (CDR1 to CDR3 respectively).
30. Amino acid sequence according to any of the preceding aspects, that is an immunoglobulin sequence.
31. Amino acid sequence according to any of the preceding aspects, that is a naturally occurring immunoglobulin sequence (from any suitable species) or a synthetic or semi-synthetic immunoglobulin sequence.
32. Amino acid sequence according to any of the preceding aspects that is a humanized immunoglobulin sequence, a camelized immunoglobulin sequence or an immunoglobulin sequence that has been obtained by techniques such as affinity maturation.
33. Amino acid sequence according to any of the preceding aspects, that essentially consists of a light chain variable domain sequence (e.g. a $V_L$-sequence); or of a heavy chain variable domain sequence (e.g. a $V_H$-sequence).
34. Amino acid sequence according to any of the preceding aspects, that essentially consists of a heavy chain variable domain sequence that is derived from a conventional four-chain antibody or that essentially consist of a heavy chain variable domain sequence that is derived from heavy chain antibody.
35. Amino acid sequence according to any of the preceding aspects, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a NANOBODY (including but not limited to a $V_{HH}$ sequence).

36. Amino acid sequence according to any of the preceding aspects, that essentially consists of a NANOBODY.
37. Amino acid sequence according to any of the preceding aspects, that essentially consists of a NANOBODY that
   i) has at least 80% amino acid identity with at least one of the amino acid sequences of SEQ ID NO's: 1 to 22, in which for the purposes of determining the degree of amino acid identity, the amino acid residues that form the CDR sequences are disregarded;
   and in which:
   ii) preferably one or more of the amino acid residues at positions 11, 37, 44, 45, 47, 83, 84, 103, 104 and 108 according to the Kabat numbering are chosen from the Hallmark residues mentioned in Table A-3.
38. Amino acid sequence according to any of the preceding aspects, that essentially consists of a NANOBODY that
   i) has at least 80% amino acid identity with at least one of the amino acid sequences of SEQ ID NO's: 560-621, in which for the purposes of determining the degree of amino acid identity, the amino acid residues that form the CDR sequences are disregarded;
   and in which:
   ii) preferably one or more of the amino acid residues at positions 11, 37, 44, 45, 47, 83, 84, 103, 104 and 108 according to the Kabat numbering are chosen from the Hallmark residues mentioned in Table A-3.
39. Amino acid sequence according to any of the preceding aspects, that essentially consists of a polypeptide that
   i) has at least 80% amino acid identity with at least one of the amino acid sequences of SEQ ID NO's: 622-729, 759-762 and 766-773, in which for the purposes of determining the degree of amino acid identity, the amino acid residues that form the CDR sequences are disregarded;
   and in which:
   ii) preferably one or more of the amino acid residues at positions 11, 37, 44, 45, 47, 83, 84, 103, 104 and 108 according to the Kabat numbering are chosen from the Hallmark residues mentioned in Table A-3.
40. Amino acid sequence according to any of the preceding aspects, that essentially consists of a humanized NANOBODY.
41. Amino acid sequence according to any of the preceding aspects, that in addition to the at least one binding site for binding against RANK-L, contains one or more further binding sites for binding against other antigens, proteins or targets.
42. Amino acid sequence directed against RANK-L, that comprises one or more stretches of amino acid residues chosen from the group consisting of:
   a) the amino acid sequences of SEQ ID NO's: 188-249;
   b) amino acid sequences that have at least 80% amino acid identity with at least one of the amino acid sequences of SEQ ID NO's: 188-249;
   c) amino acid sequences that have 3, 2, or 1 amino acid difference with at least one of the amino acid sequences of SEQ ID NO's: 188-249;
   d) the amino acid sequences of SEQ ID NO's: 312-373 and 758;
   e) amino acid sequences that have at least 80% amino acid identity with at least one of the amino acid sequences of SEQ ID NO's: 312-373 and 758;
   f) amino acid sequences that have 3, 2, or 1 amino acid difference with at least one of the amino acid sequences of SEQ ID NO's: 312-373 and 758;
   g) the amino acid sequences of SEQ ID NO's: 436-497;
   h) amino acid sequences that have at least 80% amino acid identity with at least one of the amino acid sequences of SEQ ID NO's: 436-497;
   i) amino acid sequences that have 3, 2, or 1 amino acid difference with at least one of the amino acid sequences of SEQ ID NO's: 436-497;
   or any suitable combination thereof.
43. Amino acid sequence according to aspect 42, in which at least one of said stretches of amino acid residues forms part of the antigen binding site for binding against RANK-L.
44. Amino acid sequence according to aspect 42, that comprises two or more stretches of amino acid residues chosen from the group consisting of:
   a) the amino acid sequences of SEQ ID NO's: 188-249;
   b) amino acid sequences that have at least 80% amino acid identity with at least one of the amino acid sequences of SEQ ID NO's: 188-249;
   c) amino acid sequences that have 3, 2, or 1 amino acid difference with at least one of the amino acid sequences of SEQ ID NO's: 188-249;
   d) the amino acid sequences of SEQ ID NO's: 312-373 and 758;
   e) amino acid sequences that have at least 80% amino acid identity with at least one of the amino acid sequences of SEQ ID NO's: 312-373 and 758;
   f) amino acid sequences that have 3, 2, or 1 amino acid difference with at least one of the amino acid sequences of SEQ ID NO's: 312-373 and 758;
   g) the amino acid sequences of SEQ ID NO's: 436-497;
   h) amino acid sequences that have at least 80% amino acid identity with at least one of the amino acid sequences of SEQ ID NO's: 436-497;
   i) amino acid sequences that have 3, 2, or 1 amino acid difference with at least one of the amino acid sequences of SEQ ID NO's: 439-497;
   such that (i) when the first stretch of amino acid residues corresponds to one of the amino acid sequences according to a), b) or c), the second stretch of amino acid residues corresponds to one of the amino acid sequences according to d), e), f), g), h) or i); (ii) when the first stretch of amino acid residues corresponds to one of the amino acid sequences according to d), e) or f), the second stretch of amino acid residues corresponds to one of the amino acid sequences according to a), b), c), g), h) or i); or (iii) when the first stretch of amino acid residues corresponds to one of the amino acid sequences according to g), h) or i), the second stretch of amino acid residues corresponds to one of the amino acid sequences according to a), b), c), d), e) or f).
45. Amino acid sequence according to aspect 44, in which the at least two stretches of amino acid residues forms part of the antigen binding site for binding against RANK-L.
46. Amino acid sequence according to any of aspects 42 to 44, that comprises three or more stretches of amino acid residues, in which the first stretch of amino acid residues is chosen from the group consisting of:
   a) the amino acid sequences of SEQ ID NO's: 188-249;
   b) amino acid sequences that have at least 80% amino acid identity with at least one of the amino acid sequences of SEQ ID NO's: 188-249;
   c) amino acid sequences that have 3, 2, or 1 amino acid difference with at least one of the amino acid sequences of SEQ ID NO's: 188-249;

the second stretch of amino acid residues is chosen from the group consisting of:
  d) the amino acid sequences of SEQ ID NO's: 312-373 and 758;
  e) amino acid sequences that have at least 80% amino acid identity with at least one of the amino acid sequences of SEQ ID NO's: 312-373 and 758;
  f) amino acid sequences that have 3, 2, or 1 amino acid difference with at least one of the amino acid sequences of SEQ ID NO's: 312-373 and 758;

and the third stretch of amino acid residues is chosen from the group consisting of:
  g) the amino acid sequences of SEQ ID NO's: 436-497;
  h) amino acid sequences that have at least 80% amino acid identity with at least one of the amino acid sequences of SEQ ID NO's: 436-497;
  i) amino acid sequences that have 3, 2, or 1 amino acid difference with at least one of the amino acid sequences of SEQ ID NO's: 436-497.

47. Amino acid sequence according to aspect 46, in which the at least three stretches of amino acid residues forms part of the antigen binding site for binding against RANK-L.

48. Amino acid sequence according to any of aspects 42 to 47, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 560-621.

49. Amino acid sequence directed against RANK-L that cross-blocks the binding of at least one of the amino acid sequences according to any of aspects 42 to 48 to RANK-L.

50. Amino acid sequence directed against RANK-L that is cross-blocked from binding to RANK-L by at least one of the amino acid sequences according to any of aspects 42 to 48.

51. Amino acid sequence according to any of aspects 49 or 50 wherein the ability of said amino acid sequence to cross-block or to be cross-blocked is detected in a BIACORE assay.

52. Amino acid sequence according to any of aspects 49 or 50 wherein the ability of said amino acid sequence to cross-block or to be cross-blocked is detected in an ELISA assay.

53. Amino acid sequence according to any of aspects 42 to 52, that is in essentially isolated form.

54. Amino acid sequence according to any of aspects 42 to 53, for administration to a subject, wherein said amino acid sequence does not naturally occur in said subject.

55. Amino acid sequence according to any of aspects 42 to 54, that can specifically bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

56. Amino acid sequence according to any of aspects 42 to 55, that can specifically bind to RANK-L with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

57. Amino acid sequence according to any of aspects 42 to 56, that can specifically bind to RANK-L with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

58. Amino acid sequence according to any of aspects 42 to 57, that can specifically bind to RANK-L with an affinity less than 500 nM, preferably less than 200 nM, more preferably less than 10 nM, such as less than 500 pM.

59. Amino acid sequence according to any of aspects 42 to 58, that is a naturally occurring amino acid sequence (from any suitable species) or a synthetic or semi-synthetic amino acid sequence.

60. Amino acid sequence according to any of aspects 42 to 59, that comprises an immunoglobulin fold or that under suitable conditions is capable of forming an immunoglobulin fold.

61. Amino acid sequence according to any of aspects 42 to 60, that is an immunoglobulin sequence.

62. Amino acid sequence according to any of aspects 42 to 61 that is a naturally occurring immunoglobulin sequence (from any suitable species) or a synthetic or semi-synthetic immunoglobulin sequence.

63. Amino acid sequence according to any of aspects 42 to 62, that is a humanized immunoglobulin sequence, a camelized immunoglobulin sequence or an immunoglobulin sequence that has been obtained by techniques such as affinity maturation.

64. Amino acid sequence according to any of aspects 42 to 63, that essentially consists of a light chain variable domain sequence (e.g. a $V_L$-sequence); or of a heavy chain variable domain sequence (e.g. a $V_H$-sequence).

65. Amino acid sequence according to any of aspects 42 to 64, that essentially consists of a heavy chain variable domain sequence that is derived from a conventional four-chain antibody or that essentially consist of a heavy chain variable domain sequence that is derived from heavy chain antibody.

66. Amino acid sequence according to any of aspects 42 to 65, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a NANOBODY (including but not limited to a $V_{HH}$ sequence).

67. Amino acid sequence according to any of aspects 42 to 66, that essentially consists of a NANOBODY.

68. Amino acid sequence according to any of aspects 42 to 67, that essentially consists of a NANOBODY that
  i) has at least 80% amino acid identity with at least one of the amino acid sequences of SEQ ID NO's: 1 to 22, in which for the purposes of determining the degree of amino acid identity, the amino acid residues that form the CDR sequences are disregarded;
  and in which:
  ii) preferably one or more of the amino acid residues at positions 11, 37, 44, 45, 47, 83, 84, 103, 104 and 108 according to the Kabat numbering are chosen from the Hallmark residues mentioned in Table A-3.

69. Amino acid sequence according to any of aspects 41 to 63, that essentially consists of a NANOBODY that
  i) has at least 80% amino acid identity with at least one of the amino acid sequences of SEQ ID NO's: 560-621, in which for the purposes of determining the degree of amino acid identity, the amino acid residues that form the CDR sequences are disregarded;

and in which:
ii) preferably one or more of the amino acid residues at positions 11, 37, 44, 45, 47, 83, 84, 103, 104 and 108 according to the Kabat numbering are chosen from the Hallmark residues mentioned in Table A-3.
70. Amino acid sequence according to any of aspects 42 to 69, that essentially consists of a humanized NANOBODY.
71. Amino acid sequence according to any of the preceding aspects, that in addition to the at least one binding site for binding formed by the CDR sequences, contains one or more further binding sites for binding against other antigens, proteins or targets.
72. Amino acid sequence that essentially consists of 4 framework regions (FR1 to FR4, respectively) and 3 complementarity determining regions (CDR1 to CDR3, respectively), in which:
CDR1 is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
and/or
CDR2 is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and/or
CDR3 is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497.
73. Amino acid sequence that essentially consists of 4 framework regions (FR1 to FR4, respectively) and 3 complementarity determining regions (CDR1 to CDR3, respectively), in which:
CDR1 is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
and
CDR2 is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and
CDR3 is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497.
74. Amino acid sequence according to any of aspects 72 to 73, in which the CDR sequences of said amino acid sequence have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 560-621.
75. Amino acid sequence directed against RANK-L that cross-blocks the binding of at least one of the amino acid sequences according to any of aspects 72 to 74 to RANK-L.
76. Amino acid sequence directed against RANK-L that is cross-blocked from binding to RANK-L by at least one of the amino acid sequences according to any of aspects 72 to 74.
77. Amino acid sequence according to any of aspects 75 or 76 wherein the ability of said amino acid sequence to cross-block or to be cross-blocked is detected in a BIA-CORE assay.
78. Amino acid sequence according to any of aspects 75 or 76 wherein the ability of said amino acid sequence to cross-block or to be cross-blocked is detected in an ELISA assay.
79. Amino acid sequence according to any of aspects 72 to 78, that is in essentially isolated form.
80. Amino acid sequence according to any of aspects 72 to 79, for administration to a subject, wherein said amino acid sequence does not naturally occur in said subject.
81. Amino acid sequence according to any of aspects 72 to 80, that can specifically bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.
82. Amino acid sequence according to any of aspects 72 to 81, that can specifically bind to RANK-L with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.
83. Amino acid sequence according to any of aspects 72 to 82, that can specifically bind to RANK-L with a rate of dissociation ($k_{off}$-rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
84. Amino acid sequence according to any of aspects 72 to 83, that can specifically bind to RANK-L with an affinity less than 500 nM, preferably less than 200 nM, more preferably less than 10 nM, such as less than 500 pM.
85. Amino acid sequence according to any of aspects 72 to 84, that is a naturally occurring amino acid sequence (from any suitable species) or a synthetic or semi-synthetic amino acid sequence.
86. Amino acid sequence according to any of aspects 72 to 85, that comprises an immunoglobulin fold or that under suitable conditions is capable of forming an immunoglobulin fold.

87. Amino acid sequence according to any of aspects 72 to 86, that is an immunoglobulin sequence.
88. Amino acid sequence according to any of aspects 72 to 87, that is a naturally occurring immunoglobulin sequence (from any suitable species) or a synthetic or semi-synthetic immunoglobulin sequence.
89. Amino acid sequence according to any of aspects 72 to 88, that is a humanized immunoglobulin sequence, a camelized immunoglobulin sequence or an immunoglobulin sequence that has been obtained by techniques such as affinity maturation.
90. Amino acid sequence according to any of aspects 73 to 89, that essentially consists of a light chain variable domain sequence (e.g. a $V_L$-sequence); or of a heavy chain variable domain sequence (e.g. a $V_H$-sequence).
91. Amino acid sequence according to any of aspects 72 to 90, that essentially consists of a heavy chain variable domain sequence that is derived from a conventional four-chain antibody or that essentially consist of a heavy chain variable domain sequence that is derived from heavy chain antibody.
92. Amino acid sequence according to any of aspects 72 to 91, that essentially consists of a domain antibody (or an amino acid sequence that is suitable for use as a domain antibody), of a single domain antibody (or an amino acid sequence that is suitable for use as a single domain antibody), of a "dAb" (or an amino acid sequence that is suitable for use as a dAb) or of a NANOBODY (including but not limited to a $V_{HH}$ sequence).
93. Amino acid sequence according to any of aspects 72 to 92, that essentially consists of a NANOBODY.
94. Amino acid sequence according to any of aspects 72 to 93, that essentially consists of a NANOBODY that
i) has at least 80% amino acid identity with at least one of the amino acid sequences of SEQ ID NO's: 1 to 22, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3.
95. Amino acid sequence according to any of aspects 72 to 94, that essentially consists of a NANOBODY that
i) has at least 80% amino acid identity with at least one of the amino acid sequences of SEQ ID NO's: 560-621, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3.
96. Amino acid sequence according to any of aspects 72 to 95, that essentially consists of a humanized NANOBODY.
97. Amino acid sequence according to any of the preceding aspects, that in addition to the at least one binding site for binding formed by the CDR sequences, contains one or more further binding sites for binding against other antigens, proteins or targets.
98. NANOBODY that is directed against and/or that can specifically bind to RANK-L.
99. NANOBODY according to aspect 98, which is directed against and/or can specifically bind to the RANK receptor binding site on RANK-L.
100. NANOBODY according to any of aspects 98 or 99, which is directed against and/or can specifically bind to the intersubunit receptor-binding grooves on the RANK-L trimer.
101. NANOBODY according to any of aspects 98 to 100, which modulates binding of RANKL-L to RANK.
102. NANOBODY according to aspect 101, which inhibits and/or prevents binding of RANKL-L to RANK.
103. NANOBODY according to aspect 102, which inhibits and/or prevents binding of RANKL-L to RANK, while not reducing and/or inhibiting the RANK-L/OPG interaction.
104. NANOBODY according to any of aspects 98 to 103, which is an antagonist of RANK-L.
105. NANOBODY according aspect 98, which is directed against and/or can specifically bind to the OPG binding site on RANK-L.
106. NANOBODY according aspects 98 or 105, which modulates binding of RANKL-L to OPG.
107. NANOBODY according to aspect 106, which inhibits the RANK/RANK-L interaction.
108. NANOBODY according to aspect 107, which is an antagonist of RANK-L.
109. NANOBODY according to aspect 106, which does not reduce or inhibit the RANK/RANK-L interaction.
110. NANOBODY according to aspect 109, which is an agonist of RANK-L.
111. NANOBODY according to aspect 98, which prevents and/or inhibits the formation of the RANK-L trimer.
112. NANOBODY according to aspect 98, which prevents and/or inhibits the differentiation and/or proliferation of osteoclasts.
113. NANOBODY according to aspect 98, which modulates bone remodelling.
114. NANOBODY according to any of aspects 98 to 113, which does not bind TRAIL.
115. NANOBODY according to any of aspects 98 to 114, which does not bind TNF-alpha.
116. NANOBODY according to any of aspects 98 to 115, which does not bind CD40 ligand.
117. NANOBODY according to any of aspects 98 to 116, which does not bind related TNF family members.
118. NANOBODY according to any of aspects 98 to 117, that is in essentially isolated form.
119. NANOBODY according to any of aspects 98 to 118, that can specifically bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.
120. NANOBODY according to any of aspects 98 to 119, that can specifically bind to RANK-L with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.
121. NANOBODY according to any of aspects 98 to 120, that can specifically bind to RANK-L with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
122. NANOBODY according to any of aspects 98 to 121, that can specifically bind to RANK-L with an affinity less than 500 nM, preferably less than 200 nM, more preferably less than 10 nM, such as less than 500 pM.
123. NANOBODY according to any of aspects 98 to 122, that is a naturally occurring NANOBODY (from any suitable species) or a synthetic or semi-synthetic NANOBODY.
124. NANOBODY according to any of aspects 98 to 123 that is a $V_{HH}$ sequence, a partially humanized $V_{HH}$ sequence, a fully humanized $V_{HH}$ sequence, a camelized heavy chain variable domain or a NANOBODY that has been obtained by techniques such as affinity maturation.
125. NANOBODY according to any of aspects 98 to 124, that
i) has at least 80% amino acid identity with at least one of the amino acid sequences of SEQ ID NO's: 1 to 22, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3.
126. NANOBODY according to any of aspects 98 to 125, that
i) has at least 80% amino acid identity with at least one of the amino acid sequences of SEQ ID NO's: 560-621, in which for the purposes of determining the degree of amino acid identity, the amino acid residues that form the CDR sequences are disregarded;
and in which:
ii) preferably one or more of the amino acid residues at positions 11, 37, 44, 45, 47, 83, 84, 103, 104 and 108 according to the Kabat numbering are chosen from the Hallmark residues mentioned in Table A-3.
127. NANOBODY according to any of aspects 98 to 126, in which:
CDR1 is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
and/or
CDR2 is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and/or
CDR3 is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 436-497.
128. NANOBODY according to any of aspects 98 to 129, in which:
CDR1 is chosen from the group consisting of:
a) the amino acid sequences of SEQ ID NO's: 188-249;
b) amino acid sequences that have at least 80% amino acid identity with at least one of the amino acid sequences of SEQ ID NO's: 188-249;
c) amino acid sequences that have 3, 2, or 1 amino acid difference with at least one of the amino acid sequences of SEQ ID NO's: 188-249;
and
CDR2 is chosen from the group consisting of:
d) the amino acid sequences of SEQ ID NO's: 312-373 and 758;
e) amino acid sequences that have at least 80% amino acid identity with at least one of the amino acid sequences of SEQ ID NO's: 312-373 and 758;
f) amino acid sequences that have 3, 2, or 1 amino acid difference with at least one of the amino acid sequences of SEQ ID NO's: 312-373 and 758;
and
CDR3 is chosen from the group consisting of:
g) the amino acid sequences of SEQ ID NO's: 436-497;
h) amino acid sequences that have at least 80% amino acid identity with at least one of the amino acid sequences of SEQ ID NO's: 436-497;
i) amino acid sequences that have 3, 2, or 1 amino acid difference with at least one of the amino acid sequences of SEQ ID NO's: 439-497.
129. NANOBODY according to any of aspects 98 to 128, in which the CDR sequences have at least 70% amino acid identity, preferably at least 80% amino acid identity, more preferably at least 90% amino acid identity, such as 95% amino acid identity or more or even essentially 100% amino acid identity with the CDR sequences of at least one of the amino acid sequences of SEQ ID NO's: 560-621.
130. NANOBODY according to any of aspects 98 to 129, which is a partially humanized NANOBODY.
131. NANOBODY according to any of aspects 98 to 130, which is a fully humanized NANOBODY.
132. NANOBODY according to any of aspects 98 to 131, that is chosen from the group consisting of SEQ ID NO's: 560-621 or from the group consisting of from amino acid sequences that have more than 80%, preferably more than 90%, more preferably more than 95%, such as 99% or more sequence identity (as defined herein) with at least one of the amino acid sequences of SEQ ID NO's: 560-621.
133. NANOBODY according to any of aspects 98 to 131, which is a humanized NANOBODY that is chosen from the group consisting of SEQ ID NO's: 730-757 and 765 or from the group consisting of from amino acid sequences that have more than 80%, preferably more than 90%, more preferably more than 95%, such as 99% or more sequence identity (as defined herein) with at least one of the amino acid sequences of SEQ ID NO's: 730-757 and 765.
134. NANOBODY according to any of aspects 98 to 133, that is chosen from the group consisting of SEQ ID NO's: 560-621 or from the group consisting of SEQ ID NO's: 730-757 and 765.
135. NANOBODY directed against RANK-L that cross-blocks the binding of at least one of the amino acid sequences according to any of aspects 42 to 48 or 72 to 74 or NANOBODIES according to any of aspects 127 to 134 to RANK-L.
136. NANOBODY directed against RANK-L that is cross-blocked from binding to RANK-L by at least one of the 137. NANOBODY according to any of aspects 135 or 136 wherein the ability of said NANOBODY to cross-block or to be cross-blocked is detected in a BIACORE assay.
138. NANOBODY according to any of aspects 135 or 136 wherein the ability of said NANOBODY to cross-block or to be cross-blocked is detected in an ELISA assay.
139. Polypeptide that comprises or essentially consists of one or more amino acid sequences according to any of aspects 1 to 97 and/or one or more NANOBODIES according to any of aspects 98 to 138, and optionally further comprises one or more other amino acid binding units, optionally linked via one or more peptidic linkers.
140. Polypeptide according to aspect 139, in which said one or more binding units are immunoglobulin sequences.
141. Polypeptide according to any of aspects 139 or 140, in which said one or more other binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES.
142. Polypeptide according to any of aspects 139 to 141, in which said one or more amino acid sequences of the invention are immunoglobulin sequences.
143. Polypeptide according to any of aspects 139 to 142, in which said one or more amino acid sequences of the invention are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES.
144. Polypeptide according to any of aspects 139 to 143, that comprises or essentially consists of one or more NANOBODIES according to any of aspects 98 to 138 and in which said one or more other binding units are NANOBODIES.
145. Polypeptide according to any of aspects 139 to 144, which is a multivalent construct.
146. Polypeptide according to any of aspects 139 to 145, which is a multiparatopic construct.
147. Polypeptide according to any of aspects 139 to 146, which is a multispecific construct.
148. Polypeptide according to any of aspects 139 to 147, which has an increased half-life, compared to the corresponding amino acid sequence according to any of aspects 1 to 97 per se or NANOBODY according to any of aspects 98 to 138 per se, respectively.
149. Polypeptide according to aspect 148, in which said one or more other binding units provide the polypeptide with increased half-life, compared to the corresponding amino acid sequence according to any of aspects 1 to 97 per se or NANOBODY according to any of aspects 98 to 138 per se, respectively.
150. Polypeptide according to aspect 149, in which said one or more other binding units that provide the polypeptide with increased half-life is chosen from the group consisting of serum proteins or fragments thereof, binding units that can bind to serum proteins, an Fc portion, and small proteins or peptides that can bind to serum proteins.
151. Polypeptide according to aspect 149, in which said one or more other binding units that provide the polypeptide with increased half-life is chosen from the group consisting of human serum albumin or fragments thereof.
152. Polypeptide according to aspect 149, in which said one or more other binding units that provides the polypeptide with increased half-life are chosen from the group consisting of binding units that can bind to serum albumin (such as human serum albumin) or a serum immunoglobulin (such as IgG).
153. Polypeptide according to aspect 149, in which said one or more other binding units that provides the polypeptide with increased half-life are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES that can bind to serum albumin (such as human serum albumin) or a serum immunoglobulin (such as IgG).
154. Polypeptide according to aspect 149, in which said one or more other binding units that provides the polypeptide with increased half-life is a NANOBODY that can bind to serum albumin (such as human serum albumin) or a serum immunoglobulin (such as IgG).
155. Polypeptide according to any of aspects 148 to 154, that has a serum half-life that is at least 1.5 times, preferably at least 2 times, such as at least 5 times, for example at least 10 times or more than 20 times, greater than the half-life of the corresponding amino acid sequence according to any of aspects 1 to 97 per se or NANOBODY according to any of aspects 98 to 138 per se, respectively.
156. Polypeptide according to any of aspects 148 to 155, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects 1 to 97 per se or NANOBODY according to any of aspects 98 to 138 per se, respectively.
157. Polypeptide according to any of aspects 148 to 156, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).
158. Compound or construct, that comprises or essentially consists of one or more amino acid sequences according to any of aspects 1 to 97 and/or one or more NANOBODIES according to any of aspects 98 to 138, and optionally further comprises one or more other groups, residues, moieties or binding units, optionally linked via one or more linkers.
159. Compound or construct according to aspect 158, in which said one or more other groups, residues, moieties or binding units are amino acid sequences.
160. Compound or construct according to any of aspects 158 to 159, in which said one or more linkers, if present, are one or more amino acid sequences.
161. Compound or construct according to any of aspects 158 to 160, in which said one or more other groups, residues, moieties or binding units are immunoglobulin sequences.

162. Compound or construct according to any of aspects 158 to 161, in which said one or more other groups, residues, moieties or binding units are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES.

163. Compound or construct according to any of aspect 158 to 162, in which said one or more amino acid sequences of the invention are immunoglobulin sequences.

164. Compound or construct according to any of aspects 158 to 163, in which said one or more amino acid sequences of the invention are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES.

165. Compound or construct, that comprises or essentially consists of one or more NANOBODIES according to any of aspects 98 to 138 and in which said one or more other groups, residues, moieties or binding units are NANOBODIES.

166. Compound or construct according to any of aspects 158 to 165, which is a multivalent construct.

167. Compound or construct according to any of aspects 158 to 166, which is a multiparatopic construct.

168. Compound or construct according to any of aspects 158 to 167, which is a multispecific construct.

169. Compound or construct according to any of aspects 158 to 168, which has an increased half-life, compared to the corresponding amino acid sequence according to any of aspects 1 to 97 per se or NANOBODY according to any of aspects 98 to 138 per se, respectively.

170. Compound or construct according to aspect 169, in which said one or more other groups, residues, moieties or binding units provide the compound or construct with increased half-life, compared to the corresponding amino acid sequence according to any of aspects 1 to 97 per se or NANOBODY according to any of aspects 98 to 138 per se, respectively 171. Compound or construct according to aspect 170, in which said one or more other groups, residues, moieties or binding units that provide the compound or construct with increased half-life is chosen from the group consisting of serum proteins or fragments thereof, binding units that can bind to serum proteins, an Fc portion, and small proteins or peptides that can bind to serum proteins.

172. Compound or construct according to aspect 170, in which said one or more other groups, residues, moieties or binding units that provide the compound or construct with increased half-life is chosen from the group consisting of human serum albumin or fragments thereof.

173. Compound or construct according to aspect 170, in which said one or more other groups, residues, moieties or binding units that provides the compound or construct with increased half-life are chosen from the group consisting of binding units that can bind to serum albumin (such as human serum albumin) or a serum immunoglobulin (such as IgG).

174. Compound or construct according to aspect 170, in which said one or more other groups, residues, moieties or binding units that provides the compound or construct with increased half-life are chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES that can bind to serum albumin (such as human serum albumin) or a serum immunoglobulin (such as IgG).

175. Compound or construct according to aspect 170, in which said one or more other groups, residues, moieties or binding units that provides the compound or construct with increased half-life is a NANOBODY that can bind to serum albumin (such as human serum albumin) or a serum immunoglobulin (such as IgG).

176. Compound or construct according to any of aspects 169 to 175, that has a serum half-life that is at least 1.5 times, preferably at least 2 times, such as at least 5 times, for example at least 10 times or more than 20 times, greater than the half-life of the corresponding amino acid sequence according to any of aspects 1 to 97 per se or NANOBODY according to any of aspects 98 to 138 per se, respectively.

177. Compound or construct according to any of aspects 169 to 176, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects 1 to 978 per se or NANOBODY according to any of aspects 98 to 138 per se, respectively.

178. Compound or construct according to any of aspects 169 to 177, that has a serum half-life in human of at least about 12 hours, preferably at least 24 hours, more preferably at least 48 hours, even more preferably at least 72 hours or more; for example, of at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).

179. Monovalent construct, comprising or essentially consisting of one amino acid sequence according to any of aspects 1 to 97 and/or one NANOBODY according to any of aspects 98 to 138.

180. Monovalent construct according to aspect 179, in which said amino acid sequence of the invention is chosen from the group consisting of domain antibodies, amino acid sequences that are suitable for use as a domain antibody, single domain antibodies, amino acid sequences that are suitable for use as a single domain antibody, "dAb"'s, amino acid sequences that are suitable for use as a dAb, or NANOBODIES.

181. Monovalent construct, comprising or essentially consisting of one NANOBODY according to any of aspects 98 to 138.

182. Nucleic acid or nucleotide sequence, that encodes an amino acid sequence according to any of aspects 1 to 97, a NANOBODY according to any of aspects 98 to 138, a polypeptide according to any of aspects 139 to 157, a compound or construct according to any of aspects 158 to 178, or a monovalent construct according to any of aspects 179 to 181.

183. Nucleic acid or nucleotide sequence according to aspect 182, that is in the form of a genetic construct.

184. Host or host cell that expresses, or that under suitable circumstances is capable of expressing, an amino acid sequence according to any of aspects 1 to 97, a NANO- BODY according to any of aspects 98 to 138, a polypeptide according to any of aspects 139 to 157, a compound or construct according to any of aspects 158 to 178, or a monovalent construct according to any of aspects 179 to 181; and/or that comprises a nucleic acid or nucleotide sequence according to aspect 182, or a genetic construct according to aspect 183.

185. Composition, comprising at least one amino acid sequence according to any of aspects 1 to 97, NANOBODY according to any of aspects 98 to 138, polypeptide according to any of aspects 139 to 157, compound or construct according to any of aspects 158 to 178, monovalent construct according to any of aspects 179 to 181, or nucleic acid or nucleotide sequence according to aspects 182 to 183.

186. Composition according to aspect 185, which is a pharmaceutical composition.

187. Composition according to aspect 186, which is a pharmaceutical composition, that further comprises at least one pharmaceutically acceptable carrier, diluent or excipient and/or adjuvant, and that optionally comprises one or more further pharmaceutically active polypeptides and/or compounds.

188. Method for producing an amino acid sequence according to any of aspects 1 to 97, a NANOBODY according to any of aspects 98 to 138, a polypeptide according to any of aspects 139 to 157, a compound or construct according to any of aspects 158 to 178, a pharmaceutical composition according to any of aspects 186 or 187, or a monovalent construct according to any of aspects 179 to 181, that is such that it can be obtained by expression of a nucleic acid or nucleotide sequence encoding the same, said method at least comprising the steps of:
  expressing, in a suitable host cell or host organism or in another suitable expression system, a nucleic acid or nucleotide sequence according to aspect 182, or a genetic construct according to aspect 183, optionally followed by:
  isolating and/or purifying the amino acid sequence according to any of aspects 1 to 97, the NANOBODY according to any of aspects 98 to 138, the polypeptide according to any of aspects 139 to 157, the compound or construct according to any of aspects 158 to 178, that is such that it can be obtained by expression of a nucleic acid or nucleotide sequence encoding the same, or the monovalent construct according to any of aspects 179 to 181, thus obtained.

189. Method for producing an amino acid sequence according to any of aspects 1 to 97, a NANOBODY according to any of aspects 98 to 138, a polypeptide according to any of aspects 139 to 157, a compound or construct according to any of aspects 158 to 178, a pharmaceutical composition according to any of aspects 186 or 187, or a monovalent construct according to any of aspects 179 to 181, that is such that it can be obtained by expression of a nucleic acid or nucleotide sequence encoding the same, said method at least comprising the steps of:
  cultivating and/or maintaining a host or host cell according to aspect 184 under conditions that are such that said host or host cell expresses and/or produces at least one amino acid sequence according to any of aspects 1 to 97, NANOBODY according to any of aspects 98 to 138, polypeptide according to any of aspects 139 to 157, compound or construct according to any of aspects 158 to 178, that is such that it can be obtained by expression of a nucleic acid or nucleotide sequence encoding the same, or a monovalent construct according to any of aspects 179 to 181,
  optionally followed by:
  isolating and/or purifying the amino acid sequence according to any of aspects 1 to 97, the NANOBODY according to any of aspects 98 to 138, the polypeptide according to any of aspects 139 to 157, the compound or construct according to any of aspects 158 to 178, that is such that it can be obtained by expression of a nucleic acid or nucleotide sequence encoding the same, or the monovalent construct according to any of aspects 179 to 181 thus obtained.

190. Method for screening amino acid sequences directed against RANK-L that comprises at least the steps of:
  a) providing a set, collection or library of nucleic acid sequences encoding amino acid sequences;
  b) screening said set, collection or library of nucleic acid sequences for nucleic acid sequences that encode an amino acid sequence that can bind to and/or has affinity for RANK-L and that is cross-blocked or is cross blocking a NANOBODY of the invention, e.g. SEQ ID NO's: 560-621, or a humanized NANOBODY of the invention, e.g. SEQ ID NO's: 730-757 and 765, or a polypeptide or construct of the invention, e.g. SEQ ID NO's: 622-729, 759-762 and 766-773; and
  c) isolating said nucleic acid sequence, followed by expressing said amino acid sequence.

191. Method for the prevention and/or treatment of at least one bone disease or disorder, said method comprising administering, to a subject in need thereof, a pharmaceutically active amount of at least one amino acid sequence according to any of aspects 1 to 97, NANOBODY according to any of aspects 98 to 138, polypeptide according to any of aspects 139 to 157, compound or construct according to any of aspects 158 to 178, monovalent construct according to any of aspects 179 to 181, or composition according to aspect 186 or 187.

192. Method for the prevention and/or treatment of at least one disease or disorder that is associated with RANK-L, with its biological or pharmacological activity, and/or with the biological pathways or signalling in which RANK-L is involved, said method comprising administering, to a subject in need thereof, a pharmaceutically active amount of at least one amino acid sequence according to any of aspects 1 to 97, NANOBODY according to any of aspects 98 to 138, polypeptide according to any of aspects 139 to 157, compound or construct according to any of aspects 158 to 178, monovalent construct according to any of aspects 179 to 181, or composition according to aspect 186 or 187.

193. Method for the prevention and/or treatment of at least one disease or disorder that can be prevented and/or treated by administering, to a subject in need thereof, an amino acid sequence according to any of aspects 1 to 97, NANOBODY according to any of aspects 98 to 138, polypeptide according to any of aspects 139 to 157, compound or construct according to any of aspects 158 to 178 or a monovalent construct according to any of aspects 179 to 181, said method comprising administering, to a subject in need thereof, a pharmaceutically active amount of at least one amino acid sequence according to any of aspects 1 to 97, NANOBODY according to any of aspects 98 to 138, polypeptide according to any of aspects 139 to 157, compound or construct according to any of aspects 158 to 178, monovalent construct according to any of aspects 179 to 181, or composition according to aspect 186 or 187.

194. Method for immunotherapy, said method comprising administering, to a subject in need thereof, a pharmaceutically active amount of at least one amino acid sequence according to any of aspects 1 to 97, NANOBODY according to any of aspects 98 to 138, polypeptide according to any of aspects 139 to 157, compound or construct according to any of aspects 158 to 178, monovalent construct according to any of aspects 179 to 181, or composition according to aspect 186 or 187.

195. Use of an amino acid sequence according to any of aspects 1 to 97, NANOBODY according to any of aspects 98 to 138, polypeptide according to any of aspects 139 to 157, compound or construct according to any of aspects 158 to 178 or a monovalent construct according to any of aspects 179 to 181, in the preparation of a pharmaceutical composition for prevention and/or treatment of at least one bone disease or disorder; and/or for use in one or more of the methods according to aspects 191 to 194.

196. Amino acid sequence according to any of aspects 1 to 97, NANOBODY according to any of aspects 98 to 138, polypeptide according to any of aspects 139 to 157, compound or construct according to any of aspects 158 to 178, or a monovalent construct according to any of aspects 179 to 181 for prevention and/or treatment of at least one bone disease or disorder.

197. Part or fragment of an amino acid sequence according to any of aspects 1 to 97, or of a NANOBODY according to any of aspects 98 to 138.

198. Part or fragment according to aspect 197, which is directed against and/or can specifically bind to the RANK receptor binding site on RANK-L.

199. Part or fragment according to any of aspects 197 or 198, which is directed against and/or can specifically bind to the intersubunit receptor-binding grooves on the RANK-L trimer.

200. Part or fragment according to any of aspects 197 to 199, which modulates binding of RANKL-L to RANK.

201. Part or fragment according to aspect 200, which inhibits and/or prevents binding of RANKL-L to RANK.

202. Part or fragment according to aspect 201, which inhibits and/or prevents binding of RANKL-L to RANK, while not reducing and/or inhibiting the RANK-L/OPG interaction.

203. Part or fragment according to any of aspects 197 to 202, which is an antagonist of RANK-L 204. Part or fragment according aspect 197, which is directed against and/or can specifically bind to the OPG binding site on RANK-L.

205. Part or fragment according aspects 197 or 204, which modulates binding of RANKL-L to OPG.

206. Part or fragment according to aspect 205, which inhibits the RANK/RANK-L interaction.

207. Part or fragment according to aspect 206, which is an antagonist of RANK-L.

208. Part or fragment according to aspect 205, which does not reduce or inhibit the RANK/RANK-L interaction.

209. Part or fragment according to aspect 208, which is an agonist of RANK-L.

210. Part or fragment according to aspect 197, which prevents and/or inhibits the formation of the RANK-L trimer.

211. Part or fragment according to aspect 197, which prevents and/or inhibits the differentiation and/or proliferation of osteoclasts.

212. Part or fragment according to aspect 197, which modulates bone remodelling.

213. Part or fragment according to any of aspects 197 to 212, which does not bind TRAIL.

214. Part or fragment according to any of aspects 197 to 213, which does not bind TNF-alpha.

215. Part or fragment according to any of aspects 197 to 214, which does not bind CD40 ligand.

216. Part or fragment according to any of aspects 197 to 215, which does not bind related TNF family members.

217. Part of fragment according to any of aspects 197 to 216, that can specifically bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.

218. Part or fragment according to any of aspects 197 to 217, that can specifically bind to RANK-L with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.

219. Part or fragment according to any of aspects 197 to 218, that can specifically bind to RANK-L with a rate of dissociation ($k_{off}$-rate) between 1 s and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.

220. Compound or construct, that comprises or essentially consists of one or more parts or fragments according to any of aspects 197 to 219, and optionally further comprises one or more other groups, residues, moieties or binding units, optionally linked via one or more linkers.

221. Compound or construct according to aspect 220, in which said one or more other groups, residues, moieties or binding units are amino acid sequences.

222. Compound or construct according to any of aspects 220 or 221, in which said one or more linkers, if present, are one or more amino acid sequences.

223. Nucleic acid or nucleotide sequence, that encodes a part or fragment according to any of aspects 197 to 219 or a compound or construct according to aspect 222.

224. Composition, comprising at least one part or fragment according to any of aspects 197 to 219, compound or construct according to any of aspects 220 to 222, or nucleic acid or nucleotide sequence according to aspect 223.

225. Derivative of an amino acid sequence according to any of aspects 1 to 97, or of a NANOBODY according to any of aspects 98 to 138.

226. Derivative according to aspect 225, that can specifically bind to RANK-L.

227. Derivative according to aspect 226, which is directed against and/or can specifically bind to the RANK receptor binding site on RANK-L.

228. Derivative according to any of aspects 226 or 227, which is directed against and/or can specifically bind to the intersubunit receptor-binding grooves on the RANK-L trimer.

229. Derivative according to any of aspects 226 to 228, which modulates binding of RANKL-L to RANK.

230. Derivative according to aspect 229, which inhibits and/or prevents binding of RANKL-L to RANK.

231. Derivative according to aspect 230, which inhibits and/or prevents binding of RANKL-L to RANK, while not reducing and/or inhibiting the RANK-L/OPG interaction.

232. Derivative according to any of aspects 226 to 231, which is an antagonist of RANK-L 233. Derivative according aspect 226, which is directed against and/or can specifically bind to the OPG binding site on RANK-L.
234. Derivative according aspects 226 or 233, which modulates binding of RANKL-L to OPG.
235. Derivative according to aspect 234, which inhibits and/or prevents the RANK/RANK-L interaction.
236. Derivative according to aspect 235, which is an antagonist of RANK-L.
237. Derivative according to aspect 234, which does not reduce or inhibit the RANK/RANK-L interaction.
238. Derivative according to aspect 237, which is an agonist of RANK-L.
239. Derivative according to aspect 226, which prevents and/or inhibits the formation of the RANK-L trimer.
240. Derivative according to aspect 226, which prevents and/or inhibits the differentiation and/or proliferation of osteoclasts.
241. Derivative according to aspect 226, which modulates bone remodelling.
242. Derivative according to any of aspects 226 to 241, which does not bind TRAIL.
243. Derivative according to any of aspects 226 to 242, which does not bind TNF-alpha.
244. Derivative according to any of aspects 226 to 243, which does not bind CD40 ligand.
245. Derivative according to any of aspects 226 to 244, which does not bind related TNF family members.
246. Derivative according to any of aspects 226 to 245, that can specifically bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.
247. Derivative according to any of aspects 226 to 246, that can specifically bind to RANK-L with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}s^{-1}$.
248. Derivative according to any of aspects 226 to 247, that can specifically bind to RANK-L with a rate of dissociation ($k_{off}$ rate) between 1 $s^{-1}$ and $10^{-6}$ $s^{-1}$ preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
249. Derivative of a compound or construct according to any of aspects 158 to 178.
250. Derivative according to aspect 249, that can specifically bind to RANK-L.
251. Derivative according to any of aspects 249 to 250, that can specifically bind to RANK-L with a dissociation constant ($K_D$) of $10^{-5}$ to $10^{-12}$ moles/liter or less, and preferably $10^{-7}$ to $10^{-12}$ moles/liter or less and more preferably $10^{-8}$ to $10^{-12}$ moles/liter.
252. Derivative according to any of aspects 249 to 251, that can specifically bind to RANK-L with a rate of association ($k_{on}$-rate) of between $10^2$ $M^{-1}s^{-1}$ to about $10^7$ $M^{-1}s^{-1}$, preferably between $10^3$ $M^{-1}s^{-1}$ and $10^7$ $M^{-1}s^{-1}$, more preferably between $10^4$ $M^{-1}s^{-1}$ and $10^7$ $M^{-1}s^{-1}$, such as between $10^5$ $M^{-1}s^{-1}$ and $10^7$ $M^{-1}$ $s^{-1}$.
253. Derivative according to any of aspects 249 to 252, that can specifically bind to RANK-L with a rate of dissociation ($k_{off}$ rate) between 1 $s^{-1}$ and $10^{-6}$ $s^{-1}$, preferably between $10^{-2}$ $s^{-1}$ and $10^{-6}$ $s^{-1}$, more preferably between $10^{-3}$ $s^{-1}$ and $10^{-6}$ $s^{-1}$, such as between $10^{-4}$ $s^{-1}$ and $10^{-6}$ $s^{-1}$.
254. Derivative according to any of aspects 225 to 253, that has a serum half-life that is at least 1.5 times, preferably at least 2 times, such as at least 5 times, for example at least 10 times or more than 20 times, greater than the half-life of the corresponding amino acid sequence according to any of aspects 1 to 97 per se, NANOBODY according to any of aspects 98 to 138 per se, polypeptide according to any of aspects 139 to 157, or compound or construct according to any of aspects 158 to 178 per se.
255. Derivative according to any of aspects 225 to 254, that has a serum half-life that is increased with more than 1 hours, preferably more than 2 hours, more preferably more than 6 hours, such as more than 12 hours, or even more than 24, 48 or 72 hours, compared to the corresponding amino acid sequence according to any of aspects 1 to 97 per se or NANOBODY according to any of aspects 98 to 138 per se, polypeptide according to any of aspects 139 to 157, or compound or construct according to any of aspects 158 to 178 per se.
256. Derivative according to any of aspects 225 to 255, that has a serum half-life in human of at least about 12 hours, preferably at least 24 hours, more preferably at least 48 hours, even more preferably at least 72 hours or more; for example, at least 5 days (such as about 5 to 10 days), preferably at least 9 days (such as about 9 to 14 days), more preferably at least about 10 days (such as about 10 to 15 days), or at least about 11 days (such as about 11 to 16 days), more preferably at least about 12 days (such as about 12 to 18 days or more), or more than 14 days (such as about 14 to 19 days).
257. Derivative according to any of aspects 225 to 256, that is a pegylated derivative.
258. Compound or construct, that comprises or essentially consists of one or more derivatives according to any of aspects 225 to 257, and optionally further comprises one or more other groups, residues, moieties or binding units, optionally linked via one or more linkers.
259. Compound or construct according to aspect 258, in which said one or more other groups, residues, moieties or binding units are amino acid sequences.
260. Compound or construct according to any of aspects 258 or 259, in which said one or more linkers, if present, are one or more amino acid sequences.
261. Nucleic acid encoding one derivative to any of aspects 225 to 257 or a compound or construct according to any of aspects 258 to 260.
262. Composition, comprising at least one derivative to any of aspects 225 to 257, compound or construct according to any of aspects 258 to 260, or nucleic acid or nucleotide sequence according to aspects 261.

BRIEF DESCRIPTION OF THE DRAWINGS

FIG. 1: Results of competition ELISA with TNFα, TRAIL, CD40L and RANK-L as described in Example 3.2. A: binding of RANKL6 NANOBODY; B: binding of RANKL9 NANOBODY; C: binding of RANKL13 NANOBODY; D: binding of RANKL15 NANOBODY; E: binding of RANKL18 NANOBODY.

FIG. 2: Results of cell based competition binding assay with monovalent and trivalent anti-RANK-L NANOBODIES as described in Example 4.3. A: inhibition with RANKL13 and RANKL130 NANOBODIES; B: inhibition with RANKL15 and RANKL150 NANOBODIES; C: inhibition with RANKL18 and RANKL180 NANOBODIES.

Solid line: monovalent NANOBODY; Long dashed line: trivalent bispecific NANOBODY; Short dashed line: irrelevant NANOBODY.

FIG. 3: The effects of the NANOBODIES on the differentiation of human osteoclasts. The results are shown as TRACP 5b values. The groups are: BL=Baseline (no added compounds); C=control (100 ng/ml OPG); A1=0.05 nM; A2=0.3 nM; A3=1 nM; A4=3 nM; A5=10 nM; A6=50 nM; A7=250 nM. The results of all groups were compared separately with the results of the baseline group using one-way ANOVA. Asterisks indicate statistically significant inhibitory effects compared with baseline. All NANOBODIES inhibit dose-dependently osteoclast differentiation (***p<0.001). 3-A: RANKL60; 3-B: RANKL130; 3-C: RANK-L180.

FIG. 4: (A) Serum NTx levels expressed as % change of baseline upon administration of NANOBODIES (values below detection limit are not included). (B) Average Serum NTx levels expressed as % change of baseline upon administration of small molecule Ibamdronate (IBN) or of negative control NANOBODY ALB-1.

Figure 5:
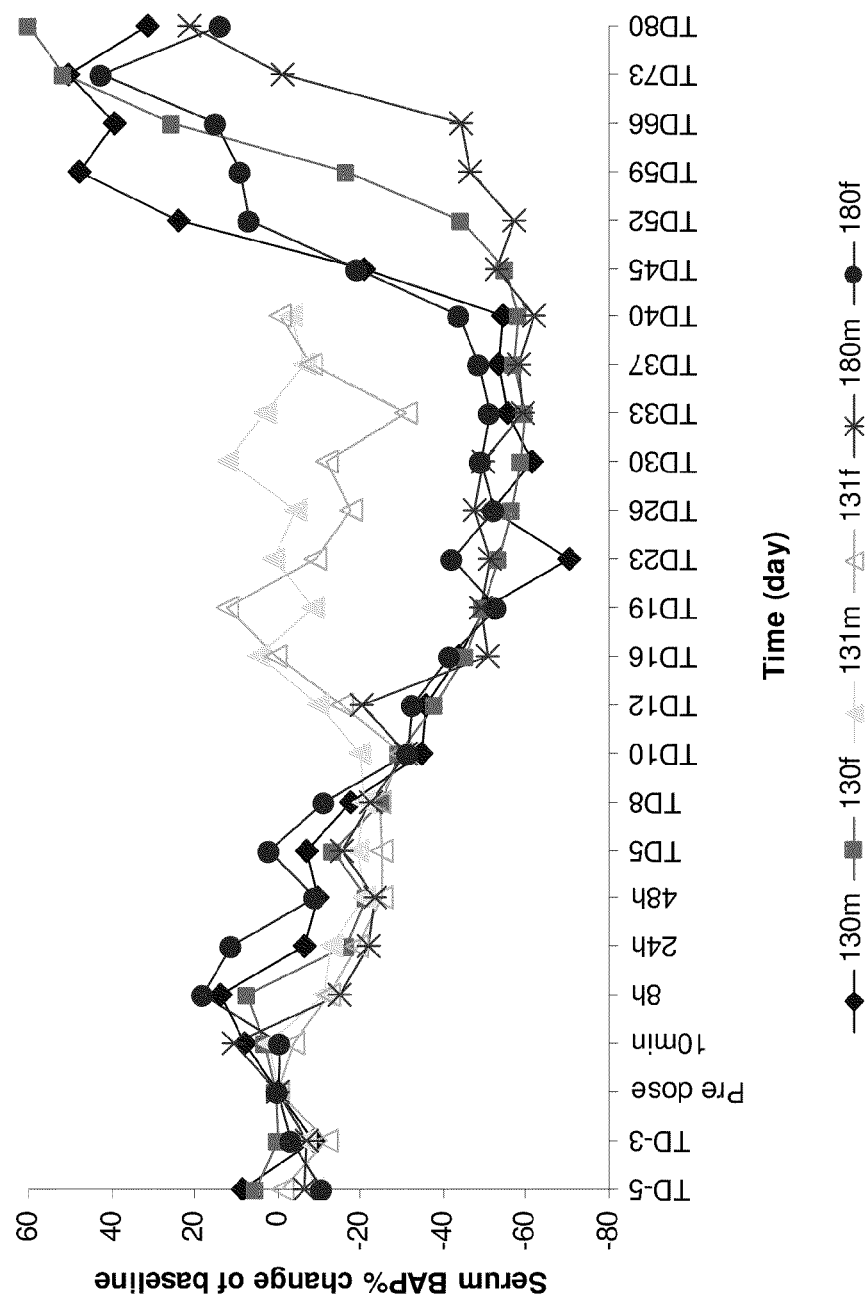

FIG. 5: Serum BAP levels expressed as % change of baseline upon administration of NANOBODIES.

FIG. 6: Alignment of humanized RANKL13hum5 (SEQ ID NO: 755) to the wild type molecule RANKL13 (SEQ ID NO: 572) and to the first 97 amino acid residues of human germline VH3-23 (SEQ ID NO: 763). Humanized aa residues are indicated in red, while CDR1, 2 and 3 are highlighted in green.

Figure 7:
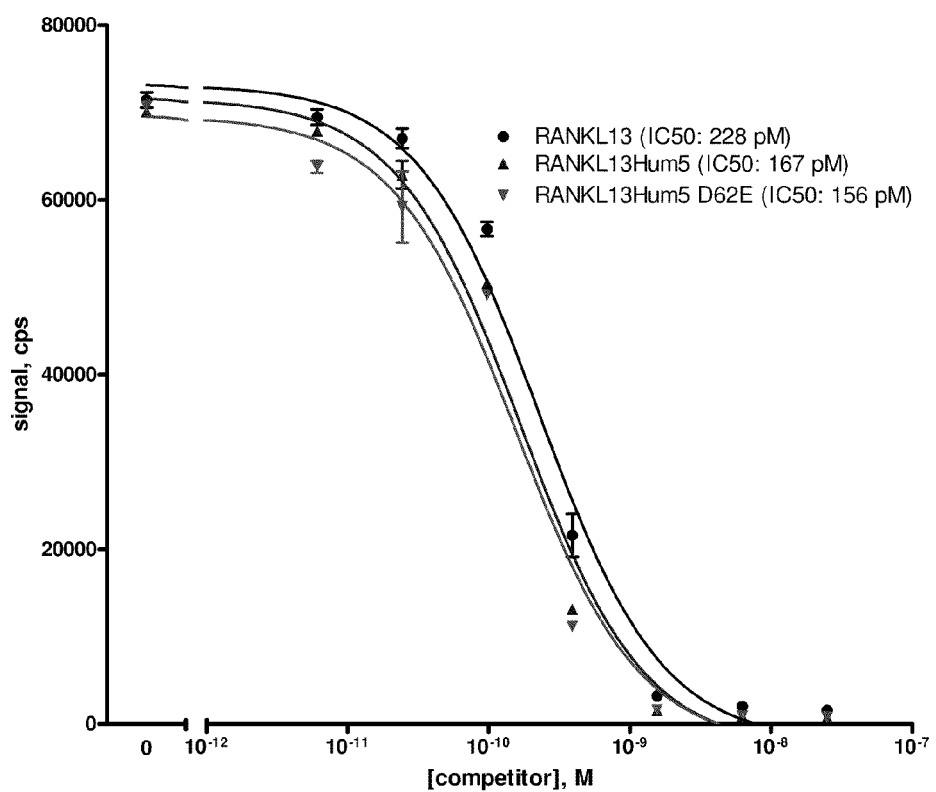

FIG. 7: Analysis of the potency of RANKL13, RANKL13hum5 and RANKL13hum5_D62E in AlphaScreen assay.

Figure 8:
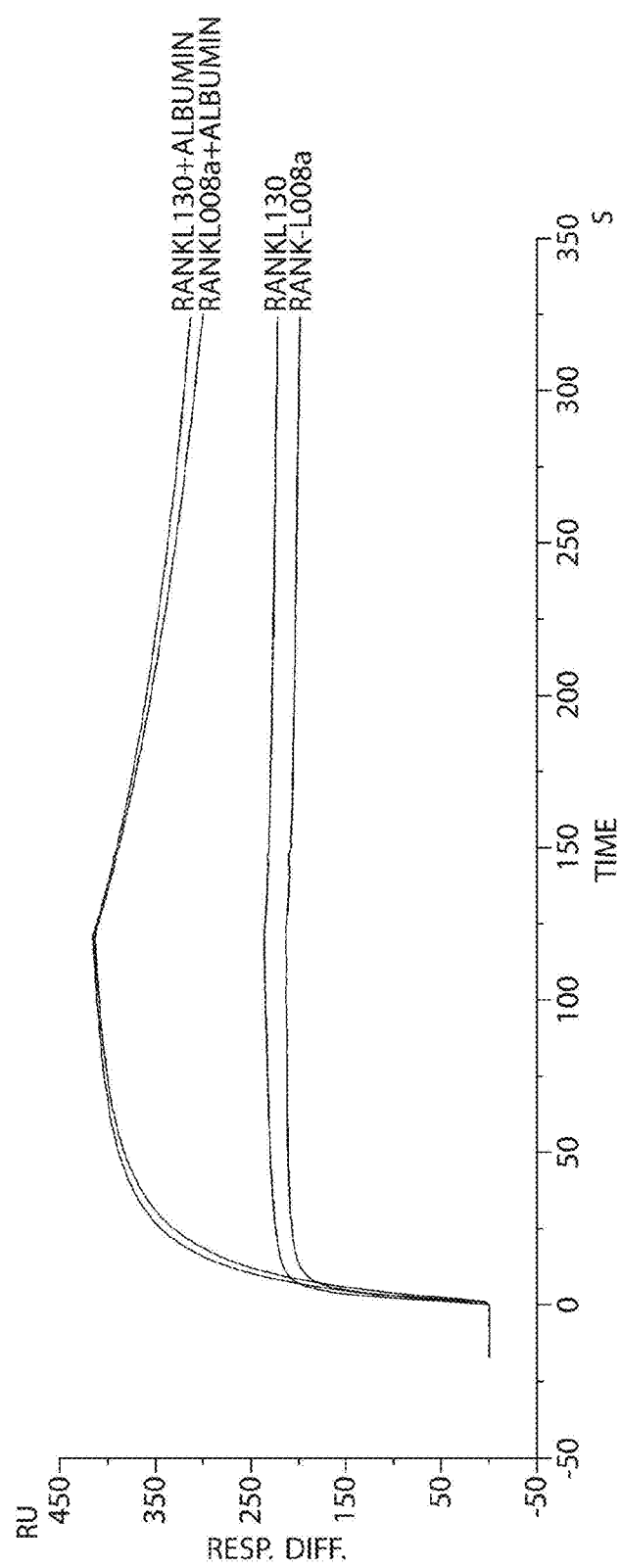

FIG. 8: Binding of RANK-L130NT and RANKL 008a to immobilized RANK-L. Binding of RANK-L 130NT (light blue) and Rank-L 008a (pink) in the presence of albumin to immobilized Rank-L.

Figure 9:
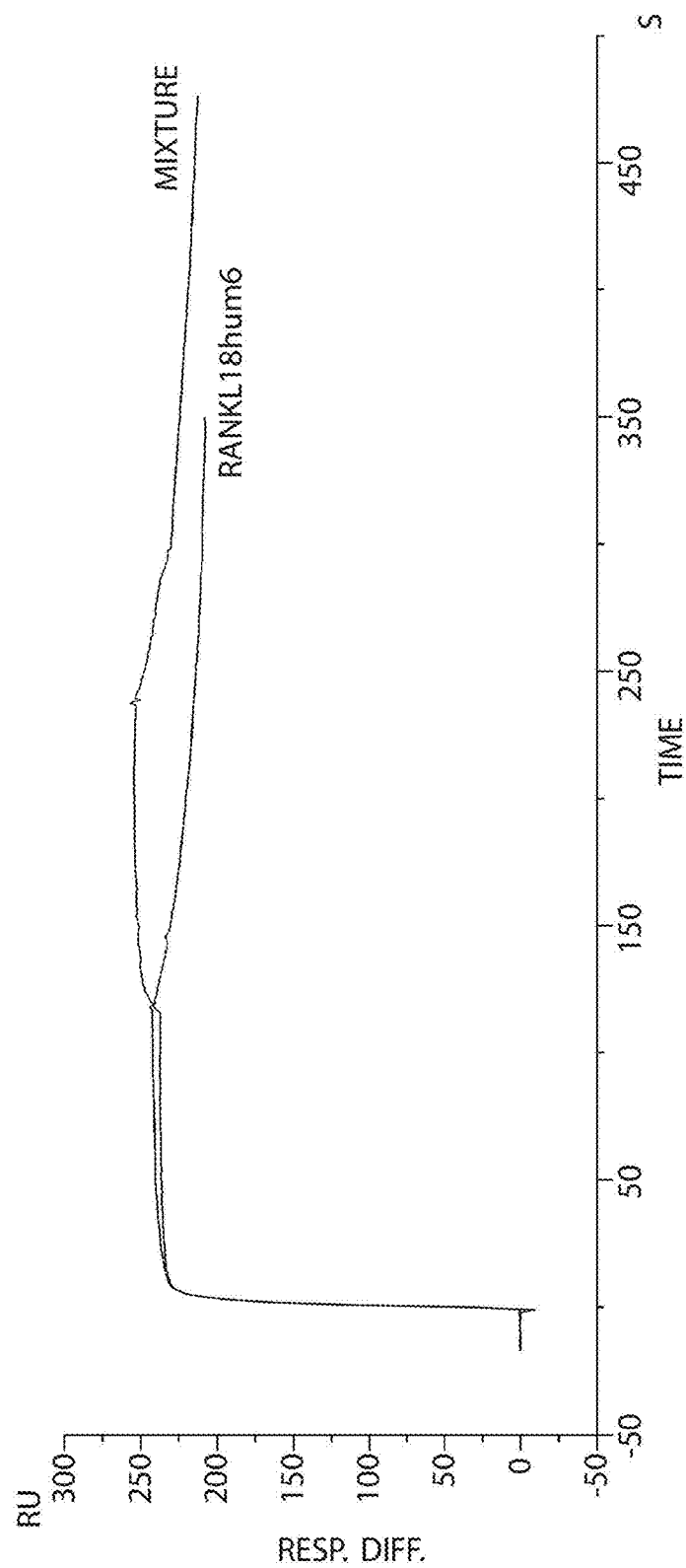

FIG. 9: Superimposed sensorgrams of binding of RANKL18hum6. RANKL18hum6: binding of 500 nM RANKL18hum6 for 120 seconds. Mixture: binding of 500 nM RANKL18hum6 for 120 seconds followed by injection of a mixture containing 500 nM of RANKL18hum6 and RANKL13hum5.

Figure 10:
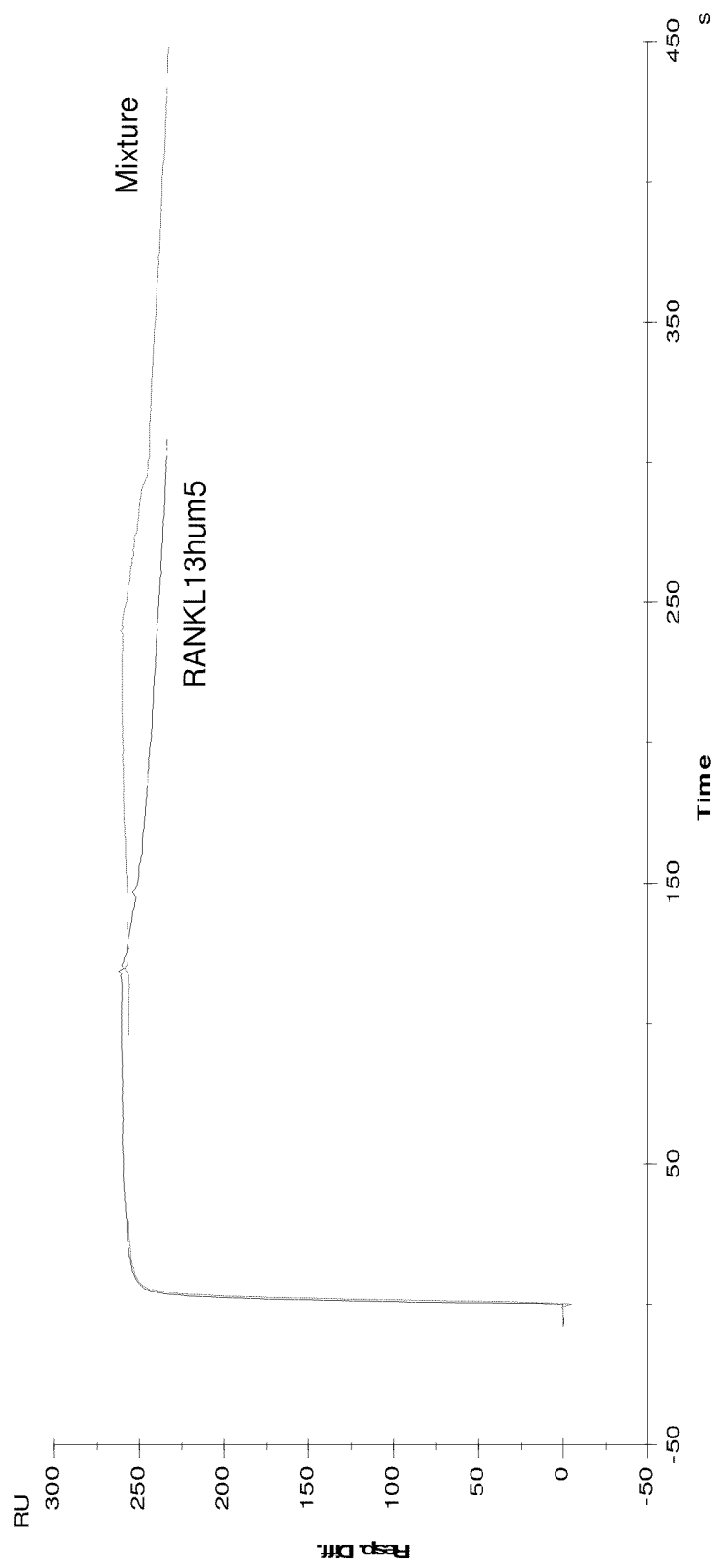

FIG. 10: Superimposed sensorgrams of binding of RANKL13hum5. RANKL13hum5: binding of 500 nM RANKL13hum5 for 120 seconds. Mixture: binding of 500 nM RANKL13hum5 for 120 seconds followed by injection of a mixture containing 500 nM of RANKL13hum5 and RANKL18hum6.

Figure 11:
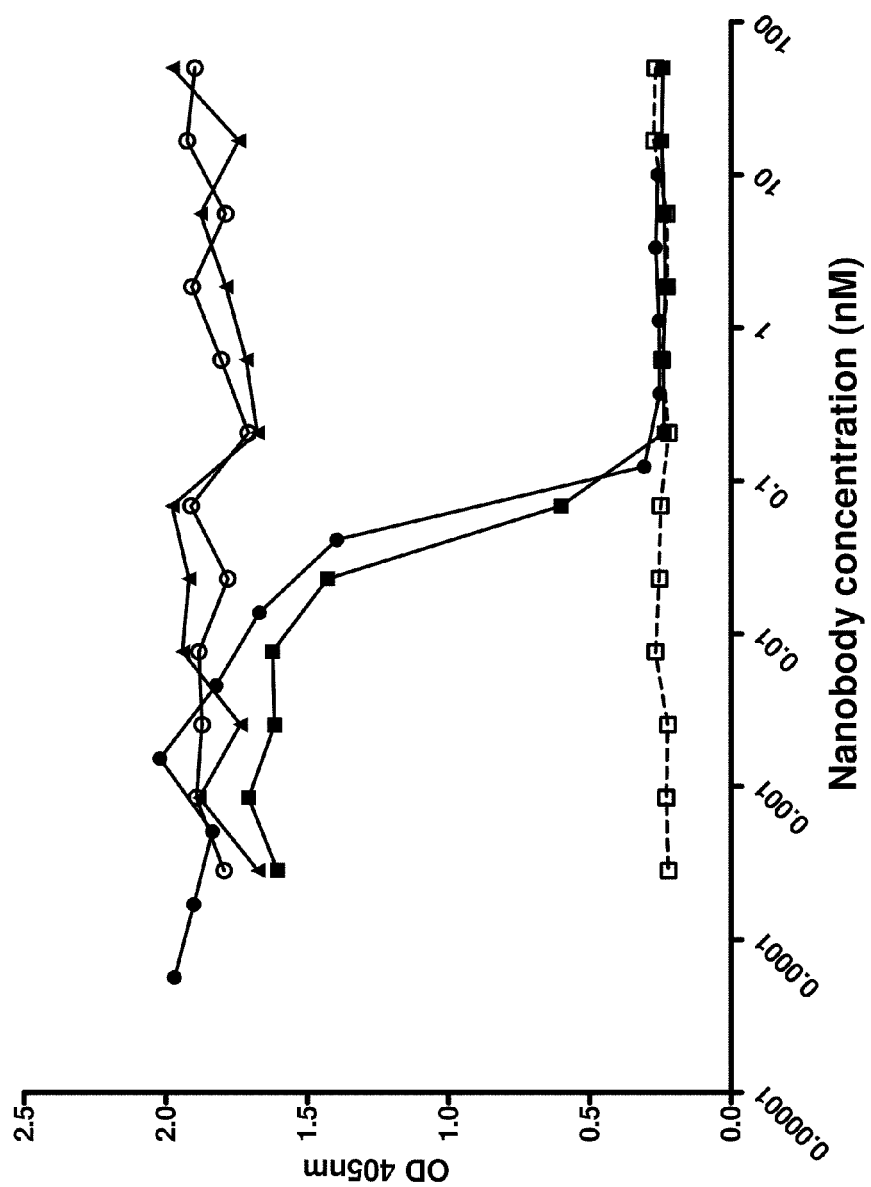

FIG. 11: Inhibition of RANK-L induced differentiation of RAW264.7 cells. RAW264.7 cells (2000 cells/well) were incubated with a dilution series of RANKL008a (●), RANKL003p (■), or an irrelevant NANOBODY (▲) and differentiation was induced with 7.5 ng/mL RANK-L. After 4 days, tartrate-resistant acid phosphatase activity in the supernatant was measured. Mean±s.e. of duplicate measurements is shown. Positive controls (i.e. without NANOBODY) are indicated using ○; negative controls (i.e. without RANK-L) are indicated using (□).

Figure 12:
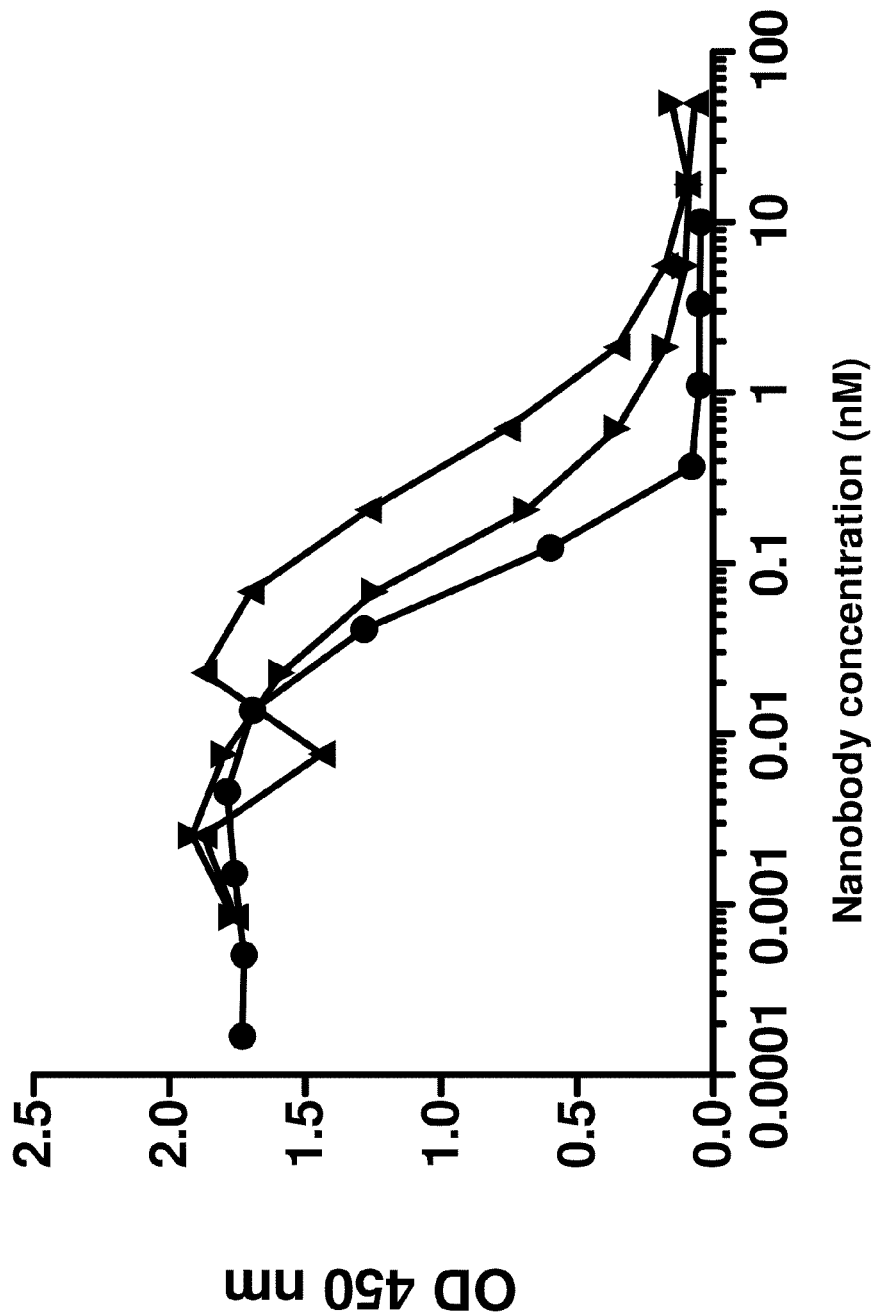

FIG. 12: Inhibition of the RANK-L interaction with RANK. A dilution series of RANKL008a (●), RANKL003p (▲) or osteoprotegerin (▼) was incubated with 7.5 ng/mL RANK-L and 200 ng/mL RANK-Fc. The mixtures were transferred to a 96-well plate coated with the anti-Fc NANOBODY PMP02. Residual bound RANK-L was detected.

Figure 13:
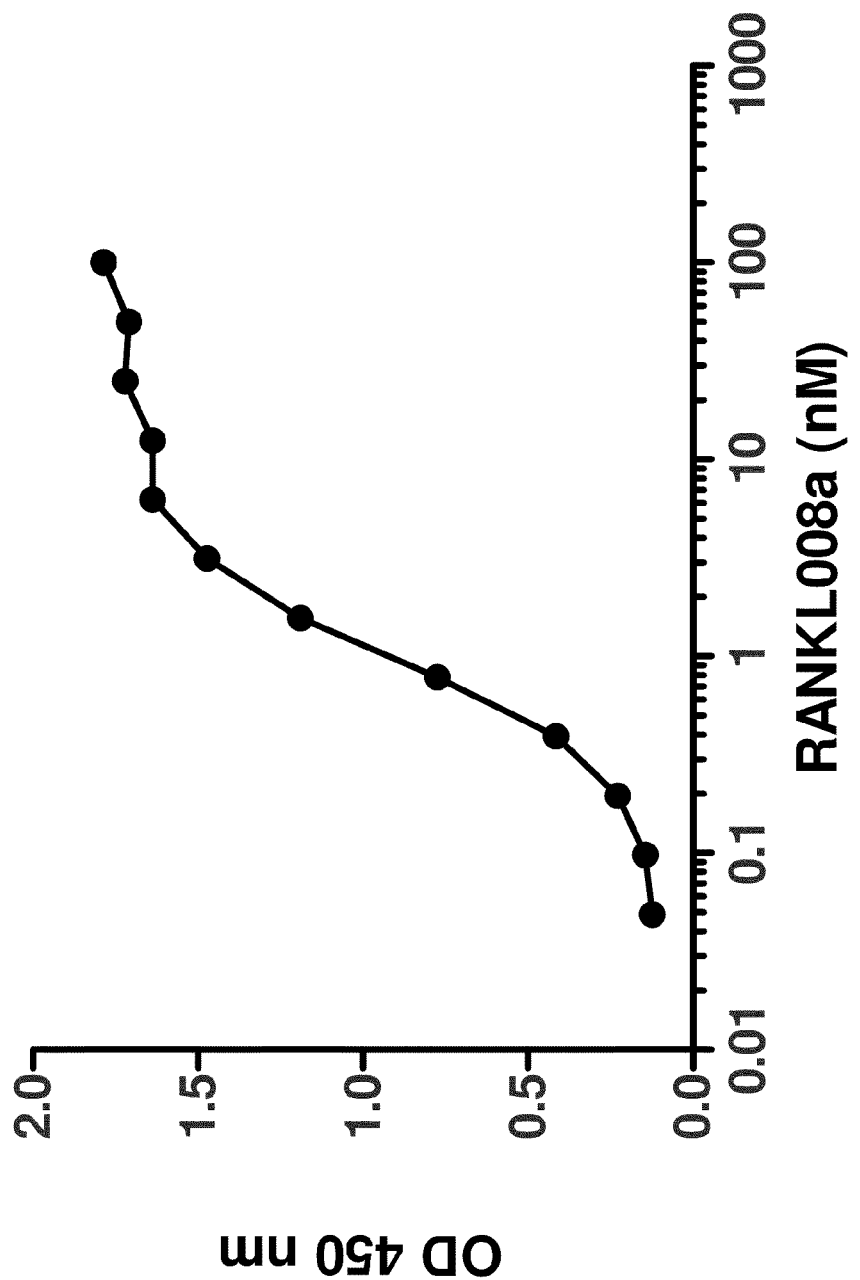

FIG. 13: Binding of RANKL008a to human serum albumin. 96-well plates were coated with HSA. After blocking, a dilution series of RANKL008a was applied. Bound RANKL008a was detected with a horseradish peroxidase labelled bivalent NANOBODY.

Figure 14:
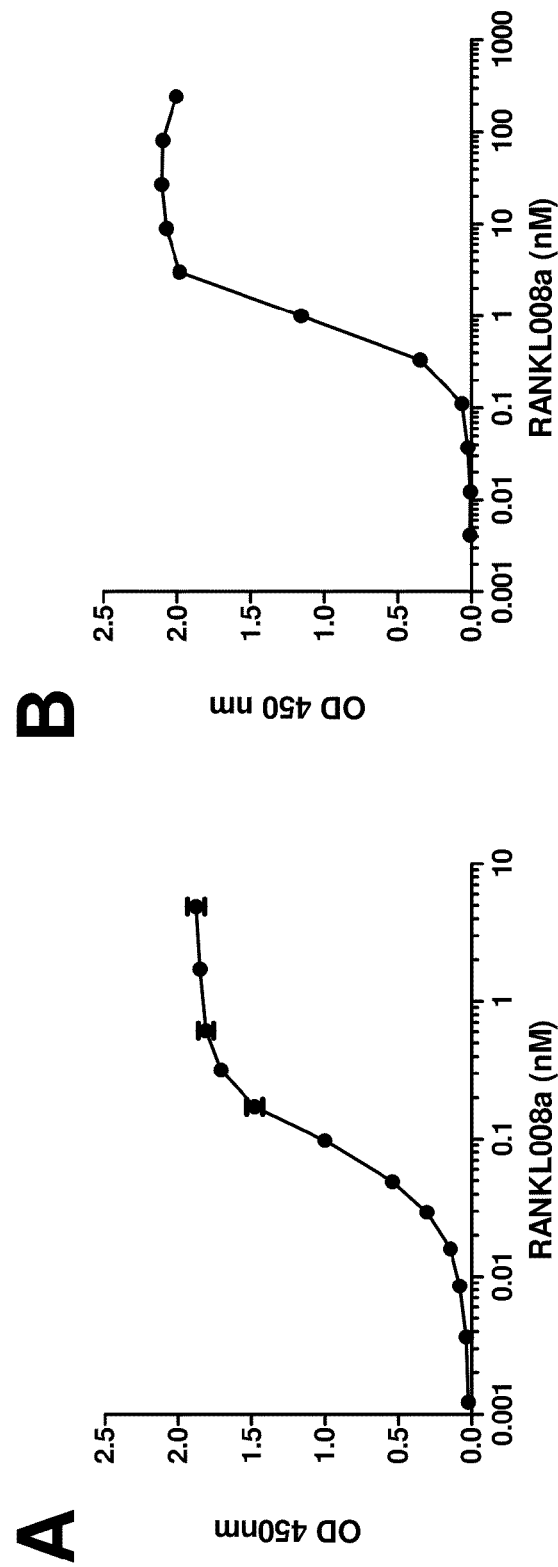

FIG. 14 Bifunctional binding of RANKL008a to HSA and RANK-L. A) Microtiter plates were coated with neutravidin after which biotinylated RANK-L was bound. Wells were incubated with a dilution series of RANKL008a. Bound RANKL008a was detected with horseradish peroxidase labelled albumin. Mean±s.e. of duplicate measurements; B) Microtiter plates were coated with HSA after which a dilution series of RANKL008a was applied. Bound RANKL008a was detected with biotinylated RANK-L followed by horseradish peroxidase labelled streptavidin.

FIG. 15: Serum NTx levels upon intravenous or subcutaneous administration (3 mg/kg) of RANKL008a (8-A), RANKL001p (8-B) or RANKL003p (8-C) NANOBODIES (values below detection limit are not included).

FIG. 16 Serum NTx levels upon administration (0.3 mg/kg; 0.03 mg/kg) of RANKL008a (9-A), RANKL001p (9-B) or RANKL003p (9-C) NANOBODIES (values below detection limit are not included).

Figure 17:
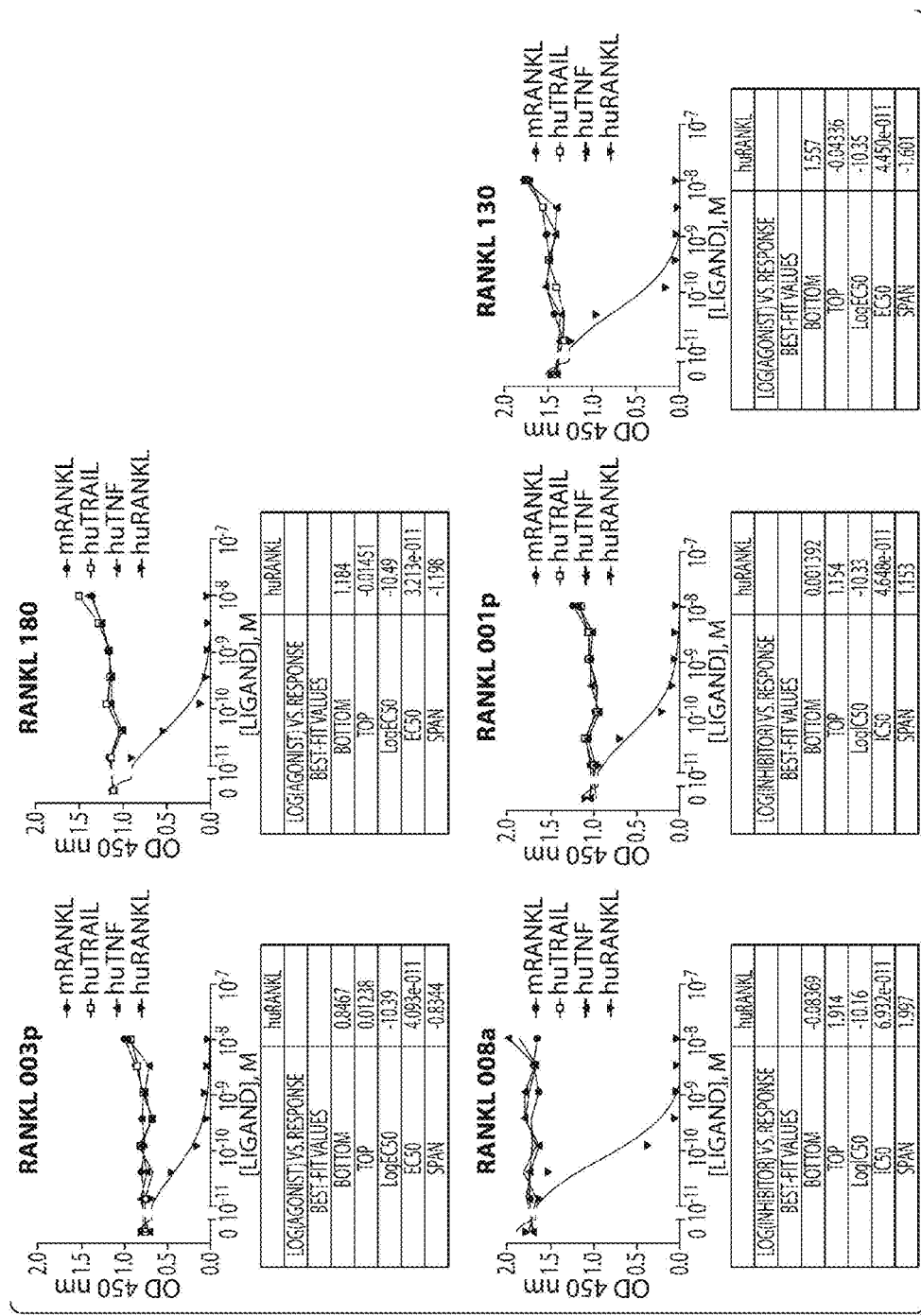

FIG. 17: Cross-reactivity of the NANOBODIES with other TNF family members TNFα and TRAIL and with mouse RANK-L.

Figure 18A:
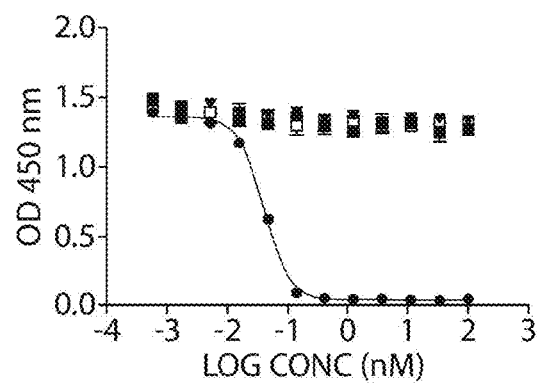
Figure 18B:
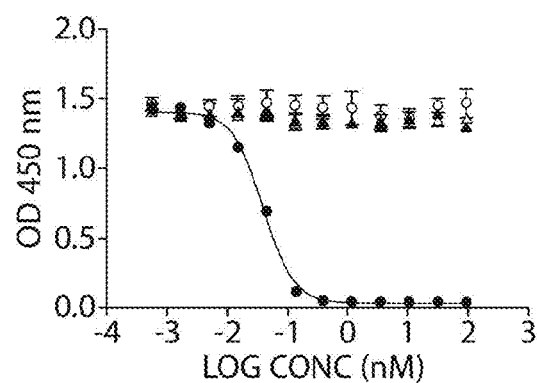
Figure 18C:
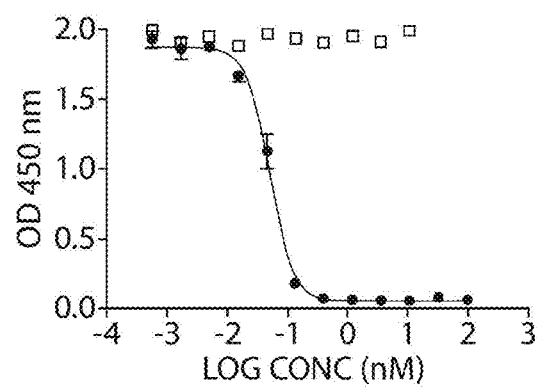

FIG. 18: Cross-reactivity of RANKL008a with TNF family members. A titration series of the different TNF superfamily proteins was pre-incubated with 0.08 nM RANKL008a, after which free RANKL008a was captured on a plate with biotinylated sRANK-L and detected with rabbit anti-VHH and anti-rabbit-HRP. The mean OD±s.e. of duplicate measurements is shown.

A: competition with sRANK-L (●), TNF-α (□), TRAIL (■) and Fas-L (▼)
B: competition with sRANK-L (●), CD40-L (▲), LTα1/β2 ( ) and LTα2/β1 (○)
C: competition with sRANKL (●) and LIGHT (□)

Figure 19:
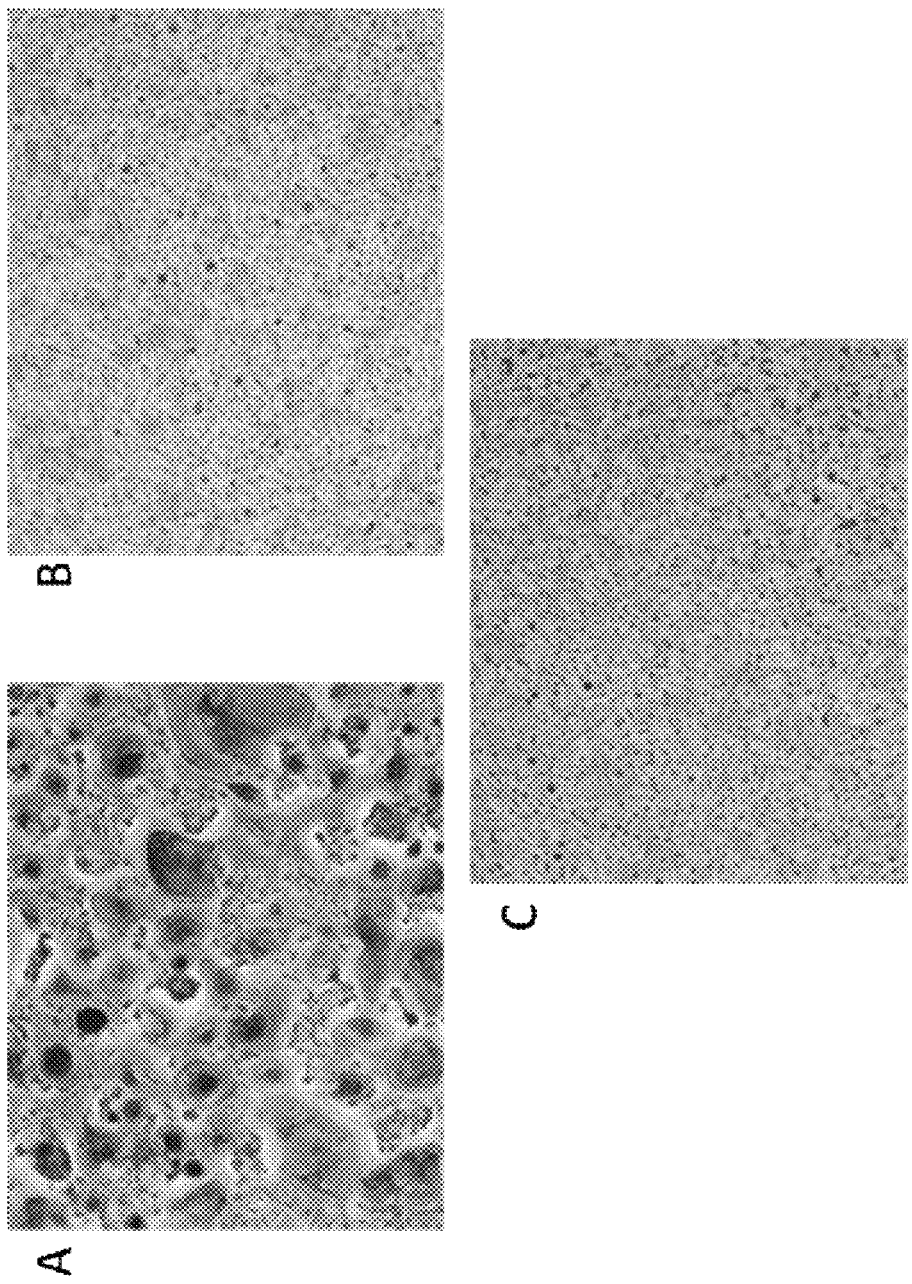

FIG. 19. Inhibition of differentiation of CD14+ monocytes to osteoclasts as measured by intracellular TRACP staining. CD14+ monocytes were isolated from PBMCs and seeded at 100.000 cells/well. Osteoclast differentiation was induced by addition of 50 ng/mL MCSF and 7.5 ng/mL RANKL in the absence (A) or presence (B) of 2 nM RANKL008a. As a control, wells were incubated without RANKL (C). After 11 days of incubation at 5% $CO_2$ and 37° C. in which 50% of the culture medium was replaced every 2 days by fresh medium, intracellular TRACP was stained. Representative image at 200× magnification is shown.

Figure 20:
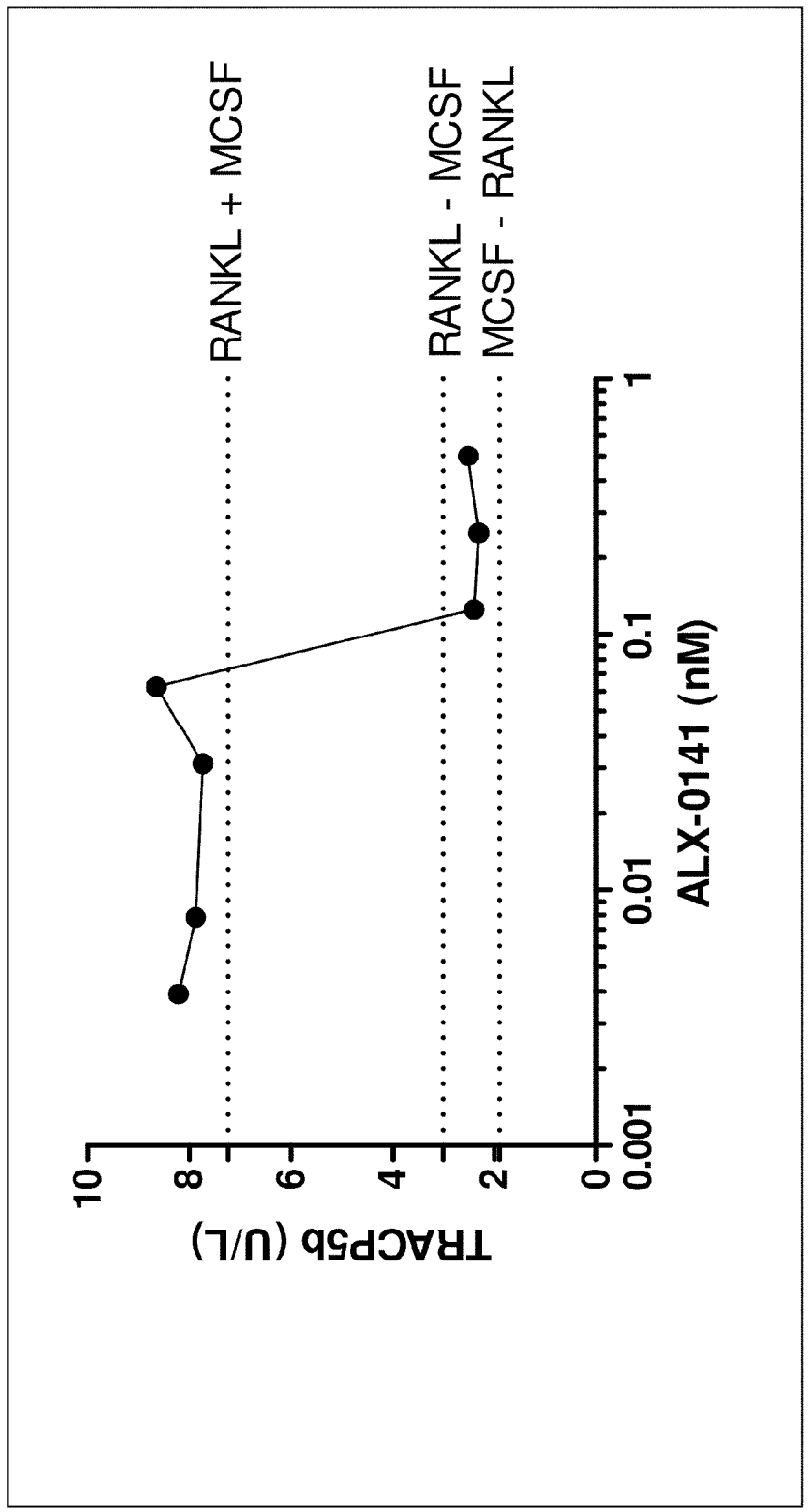

FIG. 20: Inhibition of differentiation of CD14+ monocytes to osteoclasts as measured by inhibition of TRACP5b activity in conditioned medium. CD14+ monocytes were isolated from PBMCs and seeded at 100.000 cells/well. A dilution series of RANKL008a was added and differentiation was induced by addition of RANKL (7.5 ng/mL) and MCSF (50 ng/mL). Cells were cultured for 11 days and 50% of the culture medium was replaced every 2 days by fresh medium. Differentiation was assessed by TRACP5b activity measurement in the conditioned medium. Singlicate measurements are shown. As a positive control, the TRACP5b activity measured in the absence of RANKL008a (RANKL+ MCSF) is indicated. As a negative control, the TRACP5b activity measured in the absence of MCSF (RANKL– MCSF) or RANKL (MCSF–RANKL) is shown.

Figure 21:
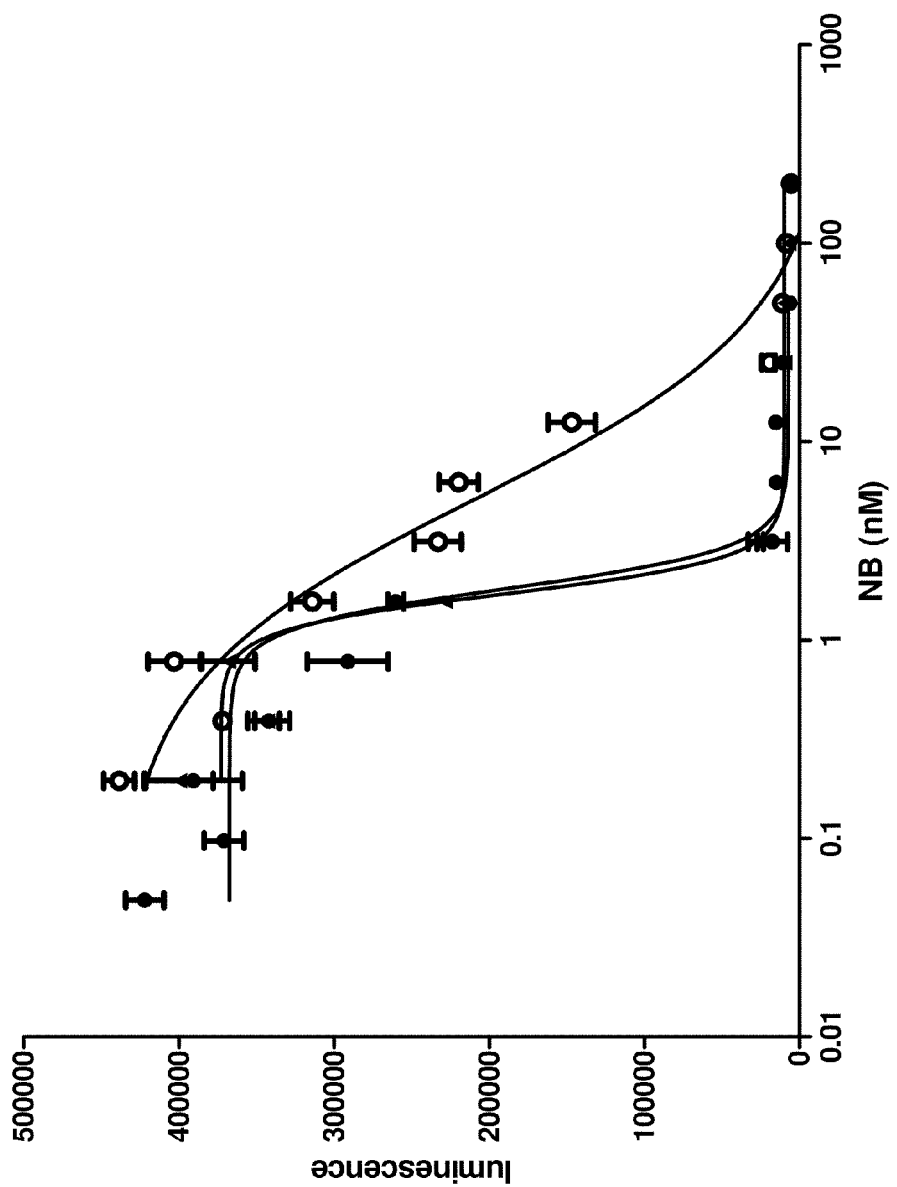

FIG. 21: Inhibition of mRANKL binding to RANK. Microtiter plates were immobilized with the anti-Fc NB PMP02. CHO cells expressing human mRANKL (400.000/mL) were preincubated for 30 min at RT with RANK-Fc (500 ng/mL) in the presence of a dilution series of RANKL008a (●), 13H5-CabLys3-13H5 (▲) or CabLys3-Alb11-13H5 (○) after which the mixtures were transferred to the coated wells. After 2 h of incubation at RT, adhered viable cells were visualized.

Figure 22:
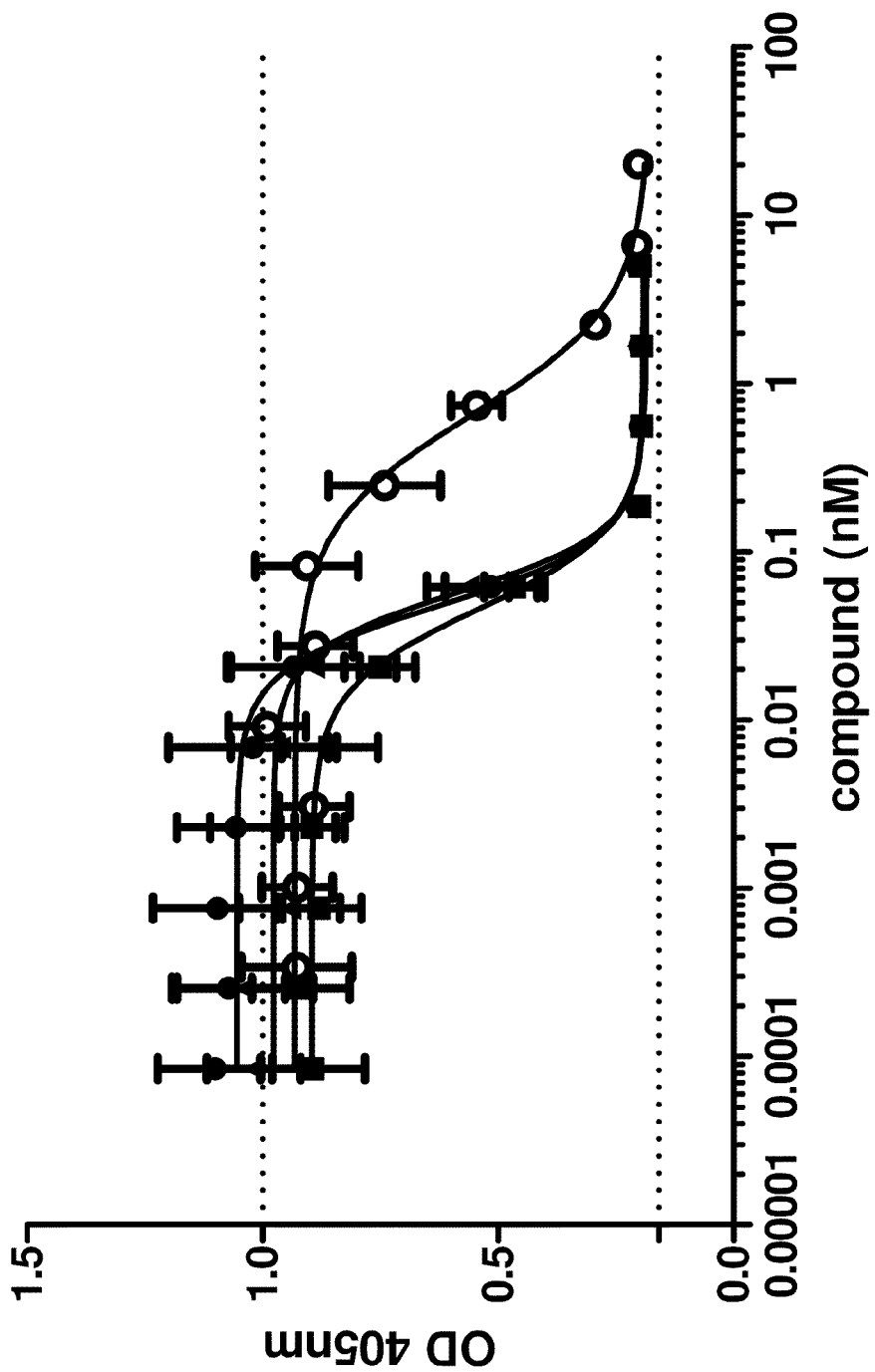

FIG. 22: Differentiation of RAW264.7 cells by mRANKL expressed on CHO cells as measured by total TRACP activity. CHO cells recombinantly expressing human mRANKL were seeded in microtiter plates at a density of 20.000 cells/well and fixed with paraformaldehyde. A dilution series of RANKL008a (●), 13H5-CabLys3-13H5 (▲), CabLys3-Alb11-13H5 (o) or αOPGL-1 (●) was added after which RAW264.7 cells were added at a density of 2000 cells/well. After 5 days of incubation at 5% $CO_2$ and 37° C., total TRACP activity in the culture supernatant was measured (mean±s.e., n=3). Total TRACP activity in the absence of compound or in the absence of CHO cells is indicated as dashed lines.

FIG. 23: Differentiation of RAW264.7 cells by mRANKL expressed on CHO cells as measured by total TRACP activity. WT CHO cells (A) or CHO cells recombinantly expressing human mRANKL (B-C) were seeded in microtiter plates at a density of 20.000 cells/well and fixed. RAW264.7 cells were added at a density of 2000 cells/well in the absence (A-B) or presence (C) of RANKL008a (0.18 nM). After 5 days of incubation at 5% $CO_2$ and 37° C., intracellular TRACP was stained. Representative image at 200× magnification is shown.

FIG. 24: Individual plasma concentration-time profiles of RANKL008a (A) and αOPGL-1 (B) following an single i.v. bolus administration at 0.3 mg/kg (RANKL008a) or 1 mg/kg (αOPGL-1) in the female Cynomolgus monkey.

Figure 25:
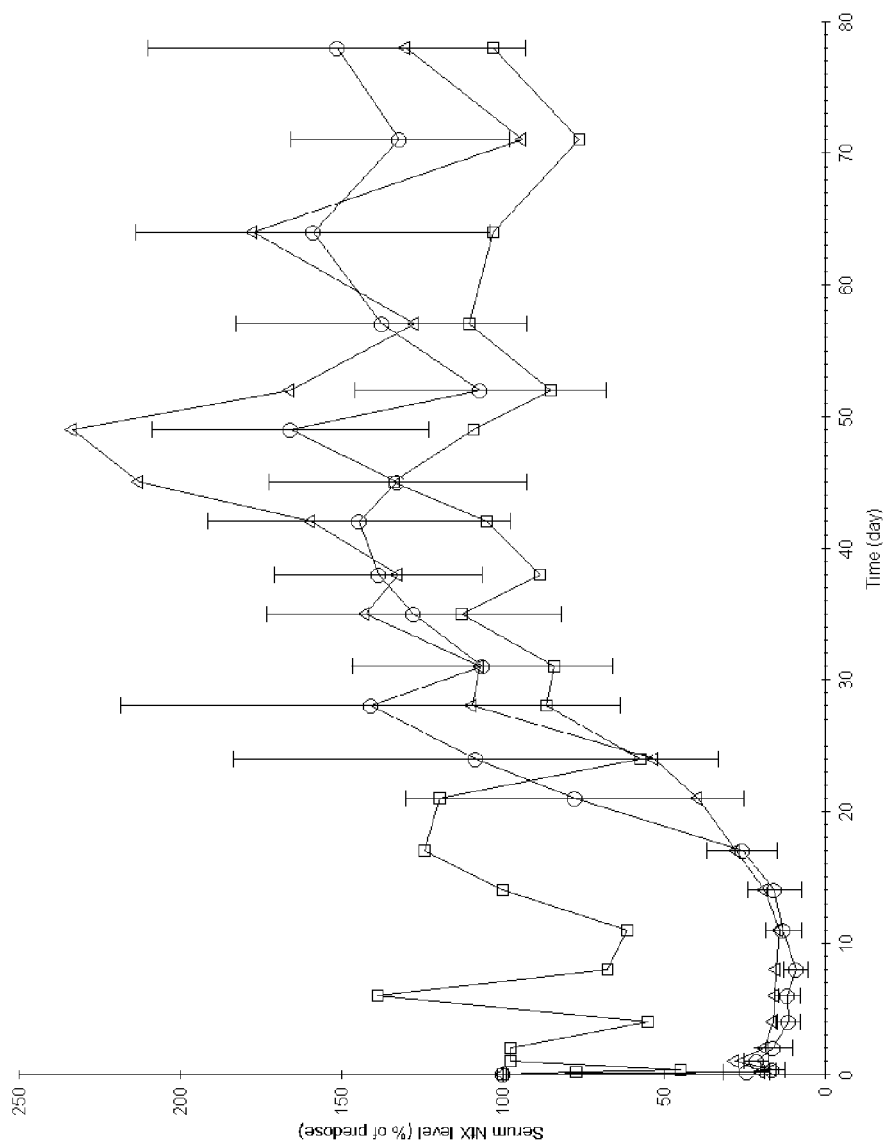

FIG. 25: Mean serum NTx-time profiles following an single i.v. bolus dose of RANKL008a at 0.3 mg/kg (circles) or of αOPGL-1 at 1 mg/kg (triangles) or PBS (squares) in the female Cynomolgus monkey.

EXAMPLES

Example 1

Identification of RANK-L Blocking NANOBODIES 1.1 Immunizations

Two llamas (No. 115 and No. 116) were immunized, according to standard protocols, with 9 intramuscular injections (100 or 50 μg/dose at weekly intervals) of alternating human RANK-L (R&D Systems, Minneapolis, Minn., US) and mouse RANK-L (R&D Systems, Minneapolis, Minn., US) in llama No. 116 and in llama No. 115 for the 5 first injections. The last four injections in llama 115 were only of human RANK-L. Both antigens were formulated in Stimune (Cedi-Diagnostics B.V., Lelystad, The Netherlands). At week 3, sera were collected to define antibody titers against human and mouse RANK-L by ELISA. In short, 96-well Maxisorp plates (Nunc, Wiesbaden, Germany) were coated with human or mouse RANK-L. After blocking and adding diluted sera samples, the presence of anti-RANK-L NANOBODIES was demonstrated by using HRP (horseradish peroxidase) conjugated goat anti-llama immunoglobulin (Bethyl Laboratories Inc., Montgomery, Tex. USA) and a subsequent enzymatic reaction in the presence of the substrate TMB (3,3',5,5'-tetramentylbenzidine) (Pierce, Rockford, Ill., USA). $OD_{450\,nm}$ exceeded 1 for human and mouse RANK-L in both animals.

1.2 Library Construction

Peripheral blood mononuclear cells were prepared from the serum samples using Ficoll-Hypaque according to the manufacturer's instructions. Next, total RNA was extracted from these cells and used as starting material for RT-PCR to amplify NANOBODY encoding gene fragments. These fragments were cloned into a house made phagemid vector. Phage was prepared according to standard methods (see for example the prior art and applications filed by applicant cited herein) and stored after filter sterilization at 4° C. for further use.

1.3 Selections

Phage libraries obtained from llamas No. 115 and No. 116 were used for different selection strategies.

In a first selection, biotinylated hRANK-L (expressed in mouse myeloma NS0 cell line) (R&D Systems, Minneapolis, US) at 1, 0.1, 0.01 μg/ml was captured on a neutravidin coated solid phase. Following incubation with the phage libraries and extensive washing, bound phage was aspecifically eluted with trypsin (1 mg/ml).

In a second selection, soluble biotinylated hRANK-L (R&D Systems, Minneapolis, US) (1 nM, 100 pM, 10 pM) was incubated with the phage libraries. After extensive washing, the biotinylated hRANK-L was captured on a neutravidin coated solid phase. Bound phage was specifically eluted with trypsin (1 mg/ml)

In a third selection hRANK-L (expressed in E. Coli) (Peprotech, London, UK) was coated onto Maxisorp 96-well plates (Nunc, Wiesbaden, Germany) at 1, 0.1, 0.01 μg/ml. Following incubation with the phage libraries and extensive washing, bound phage was aspecifically eluted with trypsin (1 mg/ml).

In all selections, enrichment was observed. The output from the selections was recloned as a pool into a house made expression vector. Colonies were picked and grown in 96 deep well plates (1 ml volume) and induced by adding IPTG for NANOBODY expression. Periplasmic extracts (volume: ~80 μl) were prepared according to standard methods (see for example the prior art and applications filed by applicant cited herein).

1.4 Screening for RANK-L Blocking NANOBODIES in Alphascreen Assay

The periplasmic extracts were screened in a RANK Alphascreen assay to evaluate the blocking capacity of the expressed NANOBODIES. This assay relies on the use of Donor and Acceptor beads which can be conjugated to biological molecules. When a biological interaction between molecules brings the beads into proximity, excited singlet oxygen molecules that are produced upon laser excitation at 680 nm by a photosensitizer in the Donor bead, diffuse across to react with a chemiluminiscer in the acceptor bead that further activates fluorophores which subsequently emit light at 520-620 nm. If the NANOBODY inhibits binding of RANK-L to RANK, fluorescent output will decrease, and the amount of NANOBODY present will be inversely related to the amount of fluorescence.

Human RANK-L was biotinylated using biotin (Sigma, St Louis, Mo., US) and biotinamidohexanoic acid 3-sulfo-N-hydroxysuccinimide ester sodium salt (Sigma, St Louis, Mo., US). RANK-huFc chimera (Alexis, Biochemicals, Lausen, Switzerland) was coupled to acceptor beads according to manufacturer instructions (Perkin Elmer, Waltham, Mass., US). To evaluate the neutralizing capacity of anti-hRANK-L NANOBODIES, dilution series of the periplasmic extracts were pre-incubated with biotinylated human RANK-L. To this mixture, the acceptor beads and the streptavidin donor beads were added and further incubated for 1 hour at room temperature. Fluorescence was measured by reading plates on the EnVision Multilabel Plate Reader (Perkin Elmer) using an excitation wavelength of 680 nm and an emission wavelength of 520 nm. Decrease in fluorescence signal indicates that the binding of biotinylated RANK-L to the RANK receptor is blocked by the NANOBODY expressed in the periplasmic extract.

From this screening inhibiting NANOBODIES were selected and sequenced. Sequencing analysis revealed 12 unique NANOBODIES and 10 NANOBODY families. The corresponding sequences are depicted in Table C-1 and Table B-1. The sequence of non-inhibitory NANOBODIES is shown in Table B-2.

Example 2

Characterization of 21 RANK-L Blocking NANOBODIES in Alphascreen Assay and ELISA 2.1 NANOBODY Expression and Purification 20 inhibitory NANOBODIES selected from the screening described in example 1 were further purified and characterised. Selected NANOBODIES were expressed in E. coli as c-myc, His6-tagged proteins in a culture volume of 50 mL. Expression was induced by addition of 1 mM IPTG and allowed to continue for 4 h at 37° C. After spinning the cell cultures, periplasmic extracts were prepared by freeze-thawing the pellets. These extracts were used as starting material for immobilized metal affinity chromatography (IMAC). NANOBODIES were eluted from the column with 150 mM imidazole and subsequently dialyzed against PBS.

2.2 NANOBODIES Bind to Soluble hRANK-L Coated on Maxisorp 96-Well Plates

First, biotinylated hRANK-L (200 ng/ml) was captured on neutravidin coated 96-well plates. Therefore 2 µg/ml neutravidin was coated overnight at 4° C. The plates were washed 5 times with 300 µl PBS and then blocked with 300 µl 1% casein/PBS for 2 hours at room temperature. After blocking biotinylated RANK-L (200 ng/ml) was added to the wells and incubated for 1 hour at room temperature. After extensive washing with PBS, varying concentrations of NANOBODIES starting from 500 nM to 160 pM diluted in 1% casein/PBS were added to the wells and the plates were incubated for 1 hour at room temperature. Bound NANOBODIES were detected by subsequent incubations of a primary mouse anti-myc antibody and a secondary anti mouse-HRP conjugate (DAKO, Glostrup, Denmark) and using TMB-H2O2 (Pierce, Rockford, Ill., USA) substrate cocktail. The reaction was stopped with $H_2SO_4$ and the OD was read at 450 nm. All NANOBODIES bound to hRANK-L coated on plates in a dose-dependent way. Calculated ED50 values are shown in Table C-2.

The same panel of NANOBODIES was also analysed for binding to murine RANK-L in a similar set-up as described for human RANK-L (see above). Only NANOBODY RANKL3 could bind to murine RANK-L in a dose-dependent way with an ED50 of approximately 600 pM.

2.3 NANOBODIES Block the Binding of RANK-L to its Cognate Receptor RANK in Alpha Screen Human RANK-L was biotinylated using biotin (Sigma, St Louis, Mo., US) and biotinamidohexanoic acid 3-sulfo-N-hydroxysuccinimide ester sodium salt (Sigma, St Louis, Mo., US). RANK-huFc chimera (1 nM) (Alexis, Biochemicals, Lausen, Switzerland) were coupled to acceptor beads according to manufacturer instructions (Perkin Elmer, Waltham, Mass., US).

A dilution series of anti-RANK-L NANOBODIES starting from 50 nM up to 1 pM was pre-incubated with 100 pM biotinylated RANK-L during 30 minutes at RT. To this mixture, the RANK acceptor beads and the streptavidin donor beads were added and further incubated for 1 hour at room temperature. Fluorescence was measured by reading plates on the EnVision Multilabel Plate Reader (Perkin Elmer) using an excitation wavelength of 680 nm and an emission wavelength of 520 nm.

Preincubation of all NANOBODIES with biotinylated RANK-L reduced fluorescence intensity at 520 nm, demonstrating that the NANOBODIES can effectively inhibit RANK-L binding to RANK in a dose-dependent manner. The calculated IC50 values are shown in Table C-3, and vary from 137 pM for RANKL9 up to 3530 pM for RANKL23.

Example 3

Binding Specificity of RANKL 6, 9, 13, 15, 18

3.1 RANKL 6, 9, 13, 15, 18 Bind Specifically to Cell Membrane Expressed Human and Cynomolgus RANK-L RANK-L of human and cynomolgus monkey was expressed in Human embryonic kidney cells (HEK293T; Wullaert et al. 2007, J. Biol. Chem. 282: 81-90) as the full length, membrane-bound protein. Binding of the NANOBODIES to the cell surface expressed RANK-L was assessed by FACS analysis of cells as described below.

Human embryonic kidney cells (HEK293T) were grown in Dulbecco's modified Eagles's medium supplemented with 10% fetal bovine serum (FBS), 2 nM L-glutamine, 0.4 mM sodium pyruvate. HEK293T cells were transiently transfected with the plasmid expressing full length human or full length cynomolgus RANK-L using FUGENE6® (non-liposomal transfection reagent) and Optimem (Roche Molecular Biochemicals, Indianapolis, Ind., US) according to manufacturer's instructions. After 48 hours, transfected cells were subjected to FACS analysis. Transfectants were seeded in 96-well plates at a final concentration of 5E+06/ml in FACS buffer (PBS+10% FBS) and incubated with varying concentrations of NANOBODY (2 nM, 400 pM, 80 pM, 16 pM, 3.2 pM for hRANK-L transfectants; 2 nM, 400 pM for cynomolgus RANK-L transfectants) for 1 hour at 4° C. Then cells were washed three times with FACS buffer. Bound NANOBODIES were detected by subsequent incubations of a primary mouse anti Myc antibody (30 min at 4° C. (2 µg/ml)) and a second incubation with goat anti mouse-Phycoerythrin (PE) (Jackson Laboratories) for another 30 min at 4° C. Finally, after washing, the cells were resuspended in PBS+10% FBS+TO-PRO®-3 (5 nM) (Molecular Probes®, Invitrogen, Merelbeke, Belgium) and cell surface fluorescence expressed as mean PE fluorescence, was measured using flow cytometry. All NANOBODIES showed dose-dependent binding to both human RANK-L and cynomolgus RANK-L expressed on HEK293T cells at all concentrations tested (Table C-4). Binding was specific since addition of 40 nM soluble human RANK-L to the incubation mixture of 400 pM NANOBODY with the HEK293T transfectants abrogated binding of the respective NANOBODY to the cells (data not shown).

3.2 RANKL 6, 9, 13, 15, 18 do not Bind to TNF Family Members TNFα, CD40 Ligand (CD40L) or TRAIL Human OPG has been reported to display weak binding to tumor necrosis factor-related apoptosis inducing ligand (TRAIL). The RANK-L amino acid sequence shows 34% similarity with that of TRAIL.

In a competition ELISA it was shown that the anti-RANK-L NANOBODIES do not bind to TNF family members TNFα, TRAIL and CD40L. RANK-L was coated on 96-well plates as described in example 2. NANOBODIES RANKL 6, 9, 13, 15 and 18 (1 nM) were preincubated with varying concentrations of RANK-L, TNFα, CD40L or TRAIL (approximately 100 nM down to 40 pM) before they were added to the plates. Binding of the NANOBODIES to the RANK-L coated plates was only inhibited by exogenously added RANK-L and was not affected by the addition of the other ligands (FIG. 1).

Example 4

Neutralizing Activity of Trivalent Bispecific Anti RANKL NANOBODIES Versus Monovalent Counterparts 4.1 Construction and Expression of Trivalent Bispecific Anti-RANK-L NANOBODIES RANKL3, RANKL6, RANKL9, RANKL13, RANKL15 and RANKL18 were also expressed as trivalent bispecific anti-RANK-L NANOBODIES. The trivalent molecules (e.g. RANKL6-ALB-RANKL6) comprise of two building blocks corresponding to anti-RANK-L NANOBODIES with in the middle a third building block corresponding to an anti Human Serum Albumin (HSA) NANOBODY building block (ALB-1; SEQ ID NO: 790). The individual building blocks were fused by a Gly/Ser (GGGGSGGGS; SEQ ID NO: 792) linker. The sequences of these trivalent bispecific anti-RANK-L NANOBODIES are shown in Table B-3. These constructs were expressed in *E. coli* as c-myc, His6-tagged proteins and subsequently purified from the culture medium by immobilized metal affinity chromatography (IMAC) and size exclusion chromatography (SEC).

4.2 Inhibition by Trivalent NANOBODIES of RANK-L Binding to RANK in Alpha-Screen 5 trivalent NANOBODIES (RANKL30: RANKL3-ALB1-RANKL3; RANKL60: RANKL6-ALB1-RANKL6, RANKL90: RANKL9-ALB1-RANKL9, RANKL130: RANKL13-ALB1-RANKL13, RANKL150: RANKL15-ALB-RANKL15, RANKL180: RANKL18-ALB1-RANKL18) were compared to their monovalent counterparts in the Alpha-Screen assay to evaluate whether they can also block RANK-L binding to its cognate receptor.

AlphaScreen was performed as described in Example 2. As shown in Table C-5, all trivalent NANOBODIES blocked RANK-L binding to the RANK receptor in a dose dependent way with increased potency as compared to the corresponding monovalent molecules.

4.3 Inhibition by Anti-RANK-L NANOBODIES of RANK-L Binding to RANK Expressed on HEK293T Cell Membranes HEK293T cells were transiently transfected with the plasmid expressing full length RANK using FUGENE6 as described in example 3. After 24 hours aliquots of 60 µl ($7.5 \times 10^3$ cells) were plated into FMAT system 384-well plates (PE Biosystems, CA, US) and allowed to adhere for 24 h. After overnight adherence, culture supernatant was removed by gently tapping the plate. To initiate the competitive screen, 20 µl ALEXA$^{647}$-labeled human RANK-L (200 pM final concentration) diluted in PBS+10% BSA (FMAT buffer) and 20 µl of a dilution series (200 nM down to 0.075 pM) of the different monovalent and trivalent NANOBODIES were added to the cell-containing FMAT system 384-well plates (PE Biosystems, CA). The plates were scanned after 10 hours of incubation. Cell surface fluorescence was measured by 8200 Cellular Detection System (Applied Biosystems, Foster City, Calif., US) which is a fluorescence macro-confocal, biological binding event analyzer that enables mix-and-read assays with live cells.

Table C-6 and FIG. 2 show that NANOBODIES blocked binding of RANK-L to its receptor in a dose dependent way and that the trivalent formats show increased potency over the monovalent molecules.

4.4 Inhibition by Anti-RANK-L NANOBODIES of RANK-L Induced NF-KB Activation in HEK293T Cells RANK-L stimulated osteoclastogenesis is associated with NF-κB activation. Most likely, RANK-L activates the most common dimer, p50/p65 (Wei et al. 2001, Endocrinology 142(3): 1290-1295). The important role of NF-kB p50 and p52 molecules in osteoclastogenesis has been shown by Xing et al. (2002, J Bone Miner. Res. 17(7): 1200-1210) reporting that NF-κB p50 and p52 are essential for RANK-expressing osteoclast precursors to differentiate into TRAP+ osteoclasts in response to RANK-L. Moreover p50 and p52 double knock out mice reportedly develop severe osteopetrosis due to the inability to generate mature osteoclasts (Franzoso et al. 1998, Genes & Development 11: 3482-3496). All together, RANK-L induced NF-κB activation is important for formation of mature osteoclasts.

To evaluate the effect of NANOBODIES on RANK-L induced NF-κB activation, HEK293T cells were transiently transfected as described in example 3 with a NF-κB reporter gene plasmid and a plasmid encoding β-galactosidase, the latter being used to correct for transfection efficiency. After 24 h, the cells were seeded in 96-well plates. Another 24 h later, cells were left untreated or were incubated in the presence of a constant amount of human RANK-L (300 ng/ml) and varying amounts of the indicated anti-RANK-L NANOBODIES (200 nM down to approximately 10 pM). After 6 hours cells were lysed; luciferase (Luc) and β-galactosidase activity were assayed using the Dual-light kit (Tropix/Applied Biosystems, Foster City, Calif., US) according to manufacturer's instructions. Luc values were normalized for β-galactosidase values to correct for differences in transfection efficiency. As shown in Table C-7, all anti-RANK-L NANOBODIES inhibit RANK-L induced NF-κB activation in a dose-dependent way. Calculated IC50 values indicate that trivalent NANOBODIES are more potent then the corresponding monovalent molecules.

Example 5

Inhibition of Osteoclast Formation by NANOBODIES

The effects of the three NANOBODIES RANKL60, RANKL130 and RANKL180 on differentiation of human osteoclasts in vitro were investigated.

The method of osteoclast culture on bone slices was originally described by Boyde and co-workers (1984; Br. Dent J. 156: 216-220) and by Chambers and Horton (1984; J. Pathol. 144: 295-6). Originally, the number of osteoclasts was determined by calculating the number of tartrate-resistant acid phosphatase (TRACP)-positive multinuclear cells under a microscope. Later, it was demonstrated that secreted TRACP 5b activity reflects the number of osteoclasts in mouse osteoclast cultures (Alatalo et al., 2000; Clin. Chem. 46: 1751-4). While secreted TRACP 5b activity correlated strongly with the number of osteoclasts, TRACP 5b was not secreted by TRACP-positive mononuclear osteoclast precursor cells before they had differentiated into mature multinuclear osteoclasts. Therefore, secreted TRACP 5b is a reliable marker of the number of mature multinuclear osteoclasts.

A human osteoclast differentiation assay was set up in which CD34+ osteoclast precursor cells derived from human bone marrow were cultured for 7 days in the presence of appropriate growth factors, including M-CSF and RANK-ligand, allowing them to differentiate into mature bone-resorbing osteoclasts (Rissanen et al., 2005; Circulation 112: 3937-46).

Human bone marrow-derived CD34+ stem cells were suspended to culture medium and allowed to attach to bovine bone slices in 96-well tissue culture plates. The culture medium contained appropriate amounts of important growth factors favoring osteoclast differentiation, including M-CSF and RANK-ligand. The cells were incubated in a CO2 incubator in humidified atmosphere of 95% air and 5% carbon dioxide at 37° C. At day 7 when osteoclast differentiation was completed, tartrate-resistant acid phosphatase isoform 5b activity (TRACP 5b) was measured from the culture medium as an index of the number of osteoclasts formed, using the BONETRAP® assay (test for the quantitative determination of the active isoform 5b of the tartrate-resistant acid phosphatase (TRACP); IDS Ltd, Boldon, UK) and VICTOR2™ Multilabel Counter (PerkinElmer, Waltham, Mass., USA).

Seven different concentrations of each NANOBODY were tested in this study, ranging from 0.05 nM to 250 nM. A baseline group without NANOBODIES and a control group with a reference molecule were included in each cell culture. Osteoprotegerin, an inhibitor of osteoclastogenesis, was used as a reference molecule to demonstrate that the test system can detect inhibition of osteoclast differentiation.

Baseline TRACP 5b values were high and the reference inhibitor OPG inhibited significantly osteoclast differentiation, which indicates that the assay was performed successfully and the results obtained reliable (FIG. 3). All three NANOBODIES inhibited dose-dependently human osteoclast differentiation. All compounds showed a statistically significant inhibition with 3.0 nM and higher concentrations. The inhibition profiles were similar for all three NANOBODIES.

Example 6

Identification of Residues on RANK-L Involved in the Interaction with the NANOBODIES 6.1 Construction of human/mouse hybrids In order to identify the binding sites of the NANOBODIES on the RANK-L molecule, the human RANK-L-specific binding of the NANOBODIES was exploited. Except for NANOBODY RANKL3, the obtained NANOBODIES did not interact with mouse RANK-L. In order to identify residues involved in the species-specific interaction on human RANK-L, three human/mouse hybrids were designed containing human/mouse substitutions in AA' and CD loops as follows:
AA' Loop:
human/mouse hybrid 1: $T^{174}D^{175}$ were substituted with A and S respectively
CD Loop:
human/mouse hybrid 2: $D^{231}L^{232}$ were substituted with S and V respectively
human/mouse hybrid 3: $A^{233}$ $TE^{235}$ were substituted with P and TD respectively The human/mouse hybrids were generated by overlap PCR using the primers showed in Table C-8. Amplicons were subsequently cloned as Xho1/Xba1 restriction fragments in an expression vector, pCIneo (Promega, Madison, Wis.).

6.2 Binding of NANOBODIES to RANK-L Human/Mouse Hybrids

HEK293T cells were transiently transfected with expression vectors encoding hRANK-L or the human/mouse hybrids. Binding of the NANOBODIES (varying concentrations: 250 nM, 50 nM, 10 nM, 2 nM, 0.4 nM, 0.08 nM, 16 pM) to the cell surface expressed RANK-L was assessed by FACS analysis of cells as described above. An overview of the binding results is presented in Table C-9.

Binding of the human/mouse cross-reactive RANKL3 NANOBODY served as a control for expression and correct folding of the different hybrid molecules. As shown in Table C-9, RANKL3 binds to the three different hybrid molecules.

The binding results with the human-specific NANOBODIES can be summarized as follows:
Loop AA' is not involved in the species-specific interaction with the NANOBODIES.
Loop CD is crucial for the interaction with the NANOBODIES.
NANOBODIES can be subdivided in different classes based on the observed differences in their interaction with the CD Loop.
RANKL13, RANKL15: Mutation of the N-terminal part and C-terminal part of the CD-loop abrogates the interaction.
RANKL9 and RANKL18: Mutation of the C-terminal part of the CD-loop abrogates the interaction. N-terminal part of the CD-loop is not involved in the interaction.
RANKL6: Mutation of the N-terminal part of the CD-loop abrogates the interaction. C-terminal part of the CD-loop is not involved in the interaction.

Example 7

Pharmacokinetics and Pharmacodynamics in Cynomolgus Monkeys

Five males and five female cynomolgus monkeys were assigned to 5 groups, each group consisting of one male and one female. Male individuals were aged between 39 and 42 months, while females had reached the age of 33 to 44 months. The animal's initial body weight varied between 2.5 and 2.7 kg for the male individuals, and 2.2 and 2.6 kg for the female individuals.

NANOBODIES RANKL130 (SEQ ID NO: 715) and RANKL180 (SEQ ID NO: 729) were tested in addition to NANOBODY RANKL131 (SEQ ID NO: 643). RANKL131 corresponds to a bivalent NANOBODY composed solely of two linker-interconnected RANKL13 building blocks. RANKL131 was included to fully assess the impact of the albumin-binding format on both PK and PD. ALB-1 (SEQ ID NO: 790) was included as a negative control and small molecule Ibandronate (LKT Laboratories, Inc, St. Paul, Minn.) served as a positive control. Animals were dosed as described in Table C-10.

Serum samples were taken for determination of the NANOBODY levels, antibody analysis, and analysis of the bone turnover markers serum N-telopeptide (serum N-Tx) and BAP (bone-specific alkaline phosphatase). Urine was also collected for analysis of N-telopeptide (urine N-Tx) and creatinine.

7.1 Pharmacokinetics

Concentrations of NANOBODIES RANKL130, RANKL180 and RANKL131 were determined in plasma as follows: 96-well microtiter plates (Maxisorp, Nunc, Wiesbaden, Germany) were coated overnight at 4° C. with 100 μL neutravidin (2 μg/mL, Pierce, Rockford, Ill.). Wells were aspirated and blocked for 30 min at RT with 300 μL SuperBlock®T20 PBS (Pierce, Rockford, Ill.). After 3 washing steps with PBS-0.05% TWEEN20 (Polysorbate 20), biotinylated RANKL (0.5 μg/mL in PBS-0.1% casein-0.05% TWEEN20) was captured by incubating 100 μL for 1 hr at RT while shaking at 600 rpm. After this incubation step, wells were washed 3 times with PBS-0.05% TWEEN20. The standards, QC and predilutions of the test samples were prepared in a non-coated (polypropylene) plate in 100% cynomolgus monkey plasma and incubated for 30 min at RT while shaking at 600 rpm. A 1/10 dilution of the samples and standards in PBS-0.1% casein-0.05% TWEEN20 (final concentration of cynomolgus monkey plasma is 10%) was transferred to the coated plate and incubated for 1 hr at RT while shaking at 600 rpm. After three washing steps with PBS-0.05% TWEEN20, the plates were incubated with an in-house purified rabbit anti-NANOBODY polyclonal antibody (1 μg/mL in PBS-0.1% casein-0.05% TWEEN20) for 1 hr at RT while shaking at 600 rpm. After 3 washing steps with PBS-0.05% TWEEN20, 100 μl horse radish peroxidase (HRP) labeled polyclonal goat anti-rabbit (1/5000 in PBS-0.1% casein-0.05% TWEEN20, DakoCytomation, Glostrup, Denmark) was incubated for 1 hr at RT while shaking at 600 rpm. Visualization was performed covered from light for 10 min with 100 μL enhanced soluble 3,3',5,5'-tetramethylbenzidine (esTMB, SDT, Brussels, Belgium), 1/3 diluted in substrate buffer. This substrate buffer was a composition of 60% $Na_2HPO_2$ (100 mM) and 40% citric acid (100 mM). After 10 min, the colouring reaction was stopped with 100 μL 1N HCl. The absorbance was determined at 450 nm after a 10 sec shake in the Tecan ELISA reader, and corrected for background absorbance at 620 nm. Concentration in each sample was determined based on a sigmoid standard curve.

Profiles for RANKL130 and RANKL180 plasma concentrations seemed to decline in a triphasic manner. In the first 2.5 days post administration, there was an initial short disposition phase (apparent alpha phase $t_{1/2}≈0.5$ days), followed by a dominant slower secondary phase (apparent beta phase) and a short final phase (apparent gamma phase) characterized by a change in terminal slope.

Individual plasma concentration-time profiles of all individuals injected with RANKL130 and RANKL180 were subjected to a non-compartmental pharmacokinetic analysis (NCA) using the pre-programmed Model 201 within Win-Nonlin Professional Software Version 5.1 (Pharsight Corporation, Mountain View Calif., USA). Individual plasma concentration-time profiles of all animals injected with RANKL131 were analyzed using the pre-programmed Model 202. The area under the plasma concentration-curve (AUC) and derived PK-parameters were calculated by means of the linear-up/log down trapezoidal rule. An overview of the calculated pharmacokinetic parameters is presented in Table C-11 and Table C-12.

Significant antibody titres to NANOBODIES are detected in four out of six animals from the RANKL130, RANKL131 and RANKL180 cohorts. The incidence was not NANOBODY-dependent since the four animals that developed antibodies originate from three different cohorts (cyno1m, cyno3m, cyno4f, cyno6f).

7.2 Pharmacodynamics

The discovery of cross-linked N-telopeptides of type I collagen (NTx) has provided a specific biochemical marker of human bone resorption. Generation of the NTx molecule is mediated by osteoclasts on bone and found in urine and serum as a stable end-product of degradation.

Changes in bone resorption induced by the NANOBODIES were assessed by assaying serum NTx and urine NTx using immunoassays according to manufacturer's instructions (Osteomark® NTx serum, Osteomark® NTx urine, Wampole Laboratories).

RANKL130 and RANKL180 caused a rapid decrease in serum NTx levels (FIG. 4). Maximal inhibition in these two test groups lasted up to at least 40 days. The serum NTx levels started to return to baseline around day 40 for cyno 1m and cyno 6f. In cyno 2f and 5m, the return to baseline initiated on day 45 and day 52, respectively. The less favourable profiles seen for cyno 1m and cyno 6f can be explained by the observed immunogenicity in these animals.

The suppression of serum NTx profiles induced by RANKL131 in cyno 3m and cyno 4f was transient, as the levels return to baseline by day 8.

The small molecule drug Ibandronate, which was administered once monthly, induced an overall inhibition of approximately 50% compared to baseline levels.

Urine NTx levels were measured up to day 16 for the RANKL130, RANKL131 and RANKL180 cohorts. Urine NTx showed similar trends to those of serum NTx.

Changes in bone formation were assessed by assaying bone-specific alkaline phosphatase (BAP) activity in serum as a quantitative measure and indicator of osteoblastic activity using the Metra® BAP immunoassay. The assay was performed according to manufacturer's instructions. RANKL130 and RANKL180 induced suppression of BAP activity (FIG. 5).

Example 8

Humanization of NANOBODIES

Humanized versions of the wild type NANOBODIES were assembled from oligonucleotides using a PCR overlap extension method. The sequences of different possible variants of RANKL6, 9, 13, 15 and 18 that were evaluated for their binding capacity and neutralizing activity in Alphascreen and in the biochemical and cellular assays as described in examples 2, 3 and 4 are shown in Table B-5.
RANKL13

The amino acid sequence of anti-RANKL NANOBODY RANKL13 (SEQ ID NO: 572) was blasted to the human germline $V_H$ sequence database using an in-house sequence query/alignment tool (FIG. 6). Human germline VH3-23 (DP-47; SEQ ID NO: 763-764) showed the closest related sequence. NANOBODY RANKL13 shows 80 identical and 7 extra conservative amino acid substitutions over the first 97 amino acid residues of human germline VH3-23. 8 amino acid residues (indicated in red) were substituted for humanization purposes to make RANKL13hum5 (SEQ ID NO: 755).

In the humanization process of RANKL13, five RANKL13 versions (RANKL13basic, RANKL13hum1, RANKL13hum2, RANL13hum3 and RANKL13hum4) were constructed. RANKL13basic contains 4 substitutions: A14P, E44G, V78L and Q108L. In addition to these changes, additional substitutions have been introduced in the hum1-4 versions: RANKL13hum1: R27F; RANKL13hum2: R30S; RANKL13hum3: A49S;

RANKL13hum4: S91Y. All versions were tested in AlphaScreen assay and binding to RANK-L was analysed by surface plasmon resonance.

All versions were tested in AlphaScreen assay. Calculated IC50 values in AlphaScreen indicate that the introduced mutations did not affect the potencies of the humanized RANKL13 versions when compared to the wild type RANKL13 (Table C-13).

Binding kinetics of the humanized versions of NANOBODY RANKL13 were also analysed by Surface Plasmon Resonance (BIACORE 3000). Human soluble RANK-L was covalently bound to CM5 sensor chips surface via amine coupling using EDC/NHS for activation and HCl for deactivation. NANOBODY binding was assessed at one concentration (100 nM). Each NANOBODY was injected for 4 minutes at a flow rate of 45 µl/min to allow binding to chip-bound antigen. Next, binding buffer without NANOBODY was sent over the chip at the same flow rate to allow spontaneous dissociation of bound NANOBODY. From the sensorgrams obtained for the different NANOBODIES $k_{off}$-values ($k_d$) were calculated and are indicated in Table C-13. Association rate constants ($k_{on}$ or $k_a$), and hence also $K_D$ values, were only indicative as only 1 concentration of NANOBODY was used to fit the binding model. As shown in Table C-13, all humanized NANOBODIES showed comparable dissociation rate constants/off rates compared to the wild type NANOBODY RANKL13.

All together, AlphaScreen data and BIACORE analysis did not indicate significant effects on binding or potency of the introduced mutations in the respective humanized versions. In a final humanized version, RANKL13hum5, all humanizing mutations were combined. As shown in Table C-13, RANKL13hum5 shows similar potency and binding affinity as the wild type RANKL13.

RANKL18

In the humanization process of RANKL18, six RANKL18 versions (RANKL18basic, RANKL18hum1, RANKL18hum2, RANL18hum3, RANKL18hum4 and RANKL18hum5) were constructed. RANKL18basic contains 4 substitutions: A14P, E44G, V78L and Q108L. In addition to these changes additional substitutions were introduced in the hum1-5 versions: RANKL18hum1: R27F; RANKL18hum2: G49S; RANKL18hum3: G60A; RANKL18hum4: P77T and V78L; RANKL18hum5: G94A. All versions were tested in AlphaScreen and BIACORE (Table C-13).

Calculated IC50 values in AlphaScreen indicated that the introduced mutations in RANKL18basic, RANKL18hum3 and RANKL18hum5 did not affect the potencies of these versions compared to the wild type RANKL18 (Table C-13). Humanizing mutations in RANKL18hum1 and RANKL18hum2 influenced moderately the potency while the double mutation in RANKL18hum4 completely abrogated the potency of the NANOBODY. Based on these results, two additional mutants, RANKL18hum6 and RANKL18hum7 were constructed and analysed. RANKL18hum6 combines humanizing mutations in RANKL18basic, RANKL18hum3 and RANKL18hum5. RANKL18hum7 includes all mutations of RANKL18hum6 together with V78L substitution. Table C-13 shows that RANKL18hum6 displays similar potency and binding affinity as the wild type RANKL18. RANKL18hum7 is slightly less potent and shows a slightly reduced binding affinity to RANK-L.

Example 9

Analysis of RANKL13hum5 D62E Mutant

Analysis of the primary sequence of RANKL13hum5 identified D62 as a potential site for isomerisation and hence as a potential source for chemical instability of the molecule. To test this possibility, a stability assay was performed with the RANKL13hum5 molecule and a mutant in which the potential isomerisation site is replaced by a glutamic acid residue (E), RANKL13hum5_D62E (SEQ ID NO: 756).

The D62E mutation in RANKL13hum5 was introduced by overlap PCR using primers including the mutation: RevRANKL13hum5D62 (CCTCCCTTTGACGGATTC-CGCGTAATACGT; SEQ ID NO: 797) and FwRANKL13hum5D62E (ACGTATTACGCGGATTC-CGTCAAAGGGAGG; SEQ ID NO: 798). Both cDNAs encoding RANKL13hum5 or RANKL13hum5_D62E were cloned as SfiI/BstEII fragments in an expression vector derived from pUC119 which contained the LacZ promoter, a resistance gene for ampicillin or carbenicillin, a multicloning site and the gen3 leader sequence. In frame with the NANOBODY coding sequence, the vector coded for two stop codons at the 3' end of the NANOBODY.

For production, RANKL13hum5 and RANKL13hum5_D62E constructs were inoculated in 50 ml TB/0.1% glucose/Kanamycin and the suspension incubated overnight at 37° C. 5×400 ml medium was inoculated with 1/100 of the obtained overnight preculture. Cultures were further incubated at 37° C., 250 rpm until OD600>5. The cultures were induced with 1 mM IPTG and further kept incubating for 4 hours at 37° C. 250 rpm. The cultures were centrifuged for 20 minutes at 4500 rpm and afterward the supernatant was discarded. The pellets were stored at −20° C.

For purification, pellets were thawed and re-suspended in 20 mL d-PBS and incubated for 1 hour at 4° C. Then, suspensions were centrifuged at 8500 rpm for 20 minutes to clear the cell debris from the periplasmic extract. NANOBODIES were purified via cation exchange (Source 30S column, wash buffer: 10 mM citric acid pH 4.0; Elution buffer 10 mM citric acid/1 M NaCl pH 4.0) followed by size exclusion chromatography (Superdex 75 Hiload 16/60 column; in d-PBS). The OD 280 nm was measured and the concentration calculated. Samples were stored at −20 C.

RANKL13hum5 and RANKL13hum5_D62E were analysed for their binding capacity and neutralizing activity in Alphascreen as described in Example 2. Humanization of RANK13 and D62E mutation in RANKL13hum5 did not interfere with potency of the NANOBODY. RANKL13, RANKL13hum5 and RANKL13hum5_D62E displayed similar potencies as measured in AlphaScreen assay (FIG. 7).

Example 10

Determination of Size of Linker Lengths in Bivalent Molecules for Optimal Potencies

RANKL13

A series of bivalent molecules containing different linker lengths were constructed. RANKL131 (RANKL13-9GS-RANKL13; SEQ ID NO: 643) and RANKL133 (RANKL13-30GS-RANKL13; SEQ ID NO: 766) contain a 9GS or a 30GS linker, respectively. Both molecules were tested in AlphaScreen assay and FMAT assay and compared to the monovalent RANKL13 and the trivalent bispecific RANKL130. Calculated IC50 values are shown in Table C-14. Both assays indicate that a 9GS linker is sufficient to obtain a similar potency as determined for RANKL130.

RANKL18

A series of bivalent molecules containing different linker lengths were constructed:
RANKL181biv: RANKL18-9GS-RANKL18 (SEQ ID NO: 657)
RANKL182biv: RANKL18-20GS-RANKL18 (SEQ ID NO: 693)
RANKL183biv: RANKL18-30GS-RANKL18 (SEQ ID NO: 767)
RANKL18hum6 Bi_25: RANKL18Hum6-25GS-RANKL18Hum6 (SEQ ID NO: 768)
RANKL 18hum6 Bi_30: RANKL18Hum6-30GS-RANKL18Hum6 (SEQ ID NO: 769)

All molecules were tested in AlphaScreen assay and FMAT assay and compared to the monovalent RANKL18 and the trivalent bispecific RANKL180. Calculated IC50 values are shown in Table C-14. Both assays indicate that a 30GS linker is required to obtain a similar potency as determined for RANKL180.

RANKL9

A series of bivalent molecules containing different linker lengths were constructed:
RANKL91biv: RANKL9-9GS-RANKL9 (SEQ ID NO: 636)
RANKL92biv: RANKL9-20GS-RANKL9 (SEQ ID NO: 672)
RANKL93biv: RANKL9-30GS-RANKL9 (SEQ ID NO: 770)
RANKL94biv: RANKL9-15GS-RANKL9 (SEQ ID NO: 771)

All molecules were tested in AlphaScreen assay and FMAT assay and compared to the monovalent RANKL9 and the trivalent bispecific RANKL90 (SEQ ID NO: 708) (Table C-14). Both assays indicate that a 15GS linker is sufficient to induce a shift in potency comparable to RANKL90.

Example 11

Construction and Production of Different Formats of the Humanized NANOBODIES

Bivalent and trivalent bispecific anti-RANKL NANOBODIES were constructed from RANKL13hum5 and RANKL18hum6. An overview of the different formatted humanized NANOBODIES with corresponding NANOBODY IDs is represented in Table C-15.

11.1 Trivalent Bispecific NANOBODIES

The trivalent bispecific molecules (RANKL008a and RANKL010a) have two building blocks corresponding to humanized anti-RANKL NANOBODIES with in the middle a third humanized NANOBODY building block corresponding to an anti-Human Serum Albumin NANOBODY building block (ALB-12; SEQ ID NO: 791). The individual building blocks are fused by a Gly/Ser (GGGGSGGGS; SEQ ID NO: 792) linker.

RANKL008a was expressed in E. coli and purified from medium and periplasmic extracts. NANOBODY was captured on MabSelect Xtra (GE Healthcare, Uppsala, Sweden). Elution occurred with buffer-B (100 mM Glycine pH2.5). Fractions were neutralized with 1.5M Tris pH 7.5 and dialysed against 1/10 PBS. Samples were subsequently subjected to Cation Exchange using a Source 15 S column (GE Healthcare, Uppsala, Sweden).

RANKL010a was cloned into pPICZalphaA (Invitrogen, Carlsbad, Calif.) and transformed in Pichia pastoris. Colonies were diluted in 250 ml BCGM medium and grown at 30° C. At OD600 of 20-25, cultures were centrifuged and pellet resuspended in 80 ml of BMCM medium. Expression was induced by addition of 100% methanol. NANOBODY was captured from the medium by capturing on MabSelect Xtra (GE Healthcare, Uppsala, Sweden). Elution fractions in 100 mM Glycine pH2.5 buffer were neutralised with 1.5M Tris pH 7.5 and dialysed against 1/10 PBS. Sample was further purified by Cation Exchange (Source 30 S column). Finally, a sizing step occurred on Superdex 75 26/60 column.

11.2 PEGylated NANOBODIES

Bivalent RANKL13hum5 and RANKL18hum6 were constructed. Constructs were expressed in E. coli. Purification and pegylation was carried out as follows:

Bivalent NANOBODY was purified via Protein A affinity chromatography (MabSelect Xtra™). After elution, using 100 mM Glycine pH 2.5, the collected sample was immediately neutralized using 1.5M Tris pH7.5. After a Cation Exchange step (Source 15S column) the fraction containing the NANOBODY® was concentrated via Vivaspin (5 kD), DTT was added to a final concentration of 10 mM and incubated over night. After free DTT was removed by SEC, PEG (3-Maleimidoproprionamide, 1,3-bis (Methoxy poly (ethylene glycol) modified 2-glycerol), Average MW 40,000; Nektar Therapeutics, San Carlos, Calif.) was added in a 5 molar excess and incubated overnight. The PEGylated NANOBODY was separated from unPEGylated NANOBODY/free PEG via MacroCap SP cation exchange (buffer: 25 mM Na-acetate pH5+0.5% pluronic). The bound proteins were eluted with a linear gradient to buffer (1×PBS+0.5% pluronic).

11.3 HSA Fusions

HSA fusion proteins, RANKL004h and RANKL006h, correspond to bivalent RANKL13hum5-9GS-RANKL13hum5 and RANKL18hum6-30GS-RANKL18hum6, respectively, which are C-terminally fused to HSA.

For the generation of RANKL004h, RANKL13hum5 was amplified by PCR using following primers:

| Sequence | SEQ ID NO |
|---|---|
| GAAGTAGGATGGACGATGACAAACCCGCGAAGACTTTTCTGGTG GCGGGAGCGAGGTGCAGCTGGTGGA | 807 |
| GTTCTATCGGGAAGACTTAGAACCTCCGCCGCCTGAGGAGACGG TGACCAG | 808 |
| GGGTATCTCTCGAGAAAAGAGAGGTGCAGCTGGTGGAGTCTGGG | 809 |
| TCTCTTCTCCTAGGTCTTTGAATCTGTGGGCGACTTCAGATTTATG AGCATCTGAGGAGACGGTGACCAG | 810 |

Subsequent amplicons were digested using appropriate restriction enzymes (N-terminal fragment: BbsI/XhoI and C-terminal fragment: BbsI/Avr II) and were cloned into a XhoI/AvrII opened pPICZalphaA-HSA vector. This vector contains the coding sequence for full length human serum albumin.

For the generation of RANKL006h, RANKL18hum6 was amplified by PCR using following primers:

| Sequence | SEQ ID NO |
|---|---|
| GGGTATCTCTCGAGAAAAGAGAGGTTCAGCTAGTGGAATCA | 811 |
| CACCTCCGGATCCTCCACCTCCGCTACCTCCACCTCCACTGCCACCTCCACCTGAGGAGACGGTGACCAG | 812 |
| GGTGGAGGATCCGGAGGTGGAGGTAGCGGAGGTGGAGGCTCAGGAGGTGGAGGCAGTGAGGTTCAGCTAGTGGAA | 813 |
| TCTCTTCTCCTAGGTCTTTGAATCTGTGGGCGACTTCAGATTTATGAGCATCTGAGGAGACGGTGACCAG | 814 |

Amplicons were digested using appropriate restriction enzymes (N-terminal fragment: BamHI/XhoI and C-terminal fragment: BamHI/Avr II) and were cloned into a XhoI/AvrII opened pPICZalphaA-HSA vector. This vector contains full length human serum albumin.

Plasmids were transformed to *Pichia pastoris*. Colonies were diluted in 250 ml BCGM medium and grown at 30° C. Expression was induced by addition of 100% methanol. NANOBODIES were purified from the medium by capturing the NANOBODIES on MabSelect Xtra (GE Healthcare, Uppsala, Sweden) and further polishing steps using Poros50HQ and Superdex200 XK26/60.

Example 12

Characterization of the Formatted Humanized NANOBODIES in AlphaScreen and FMAT Assay 12.1 Potency of the RANKL13hum5 Based Formats in AlphaScreen and FMAT Assay Trivalent bispecific NANOBODY RANKL008a, pegylated NANOBODY RANKL001p and HSA fusion protein RANKL004h were tested in AlphaScreen assay and FMAT assay and compared to the monovalent RANKL13hum5 and the wild type trivalent bispecific RANKL130. Calculated IC50 values are shown in Table C-16. In both assays RANKL008a, RANKL001p and RANKL004h displayed a similar potency that is comparable to that of RANKL130.

12.2 Potency of the RANKL18hum6 Based Formats in AlphaScreen and FMAT Assay

Trivalent bispecific NANOBODY RANKL010a and pegylated NANOBODY RANKL003p were tested in AlphaScreen assay and FMAT assay and compared to the monovalent RANKL18hum6 and the wild type trivalent bispecific RANKL180. Calculated IC50 values are shown in Table C-16. In both assays RANKL010a and RANKL003p displayed potencies that are comparable to that of RANKL180.

12.3 Effect of Albumin on Binding Kinetics of RANKL13 with Anti-Human Serum Albumin NANOBODY Building Block An experiment was performed with wild type RANKL130NT (RANKL13-ALB-1-RANKL13) and humanized RANKL008a (RANKL13hum5-ALB-12-RANKL13hum5). In this experiment a 100 nM solution was passed over a chip with immobilized RANK-L. As shown in FIG. 8, the sensorgrams in the absence of albumin are comparable for both molecules (wild type and humanized) suggesting that both molecules interact in a similar way with immobilized RANKL. Subsequently a mixture was prepared (100 nM of the NANOBODY with 500 nM HSA) and passed over the chip. As the signal was significantly higher for the complex, we conclude that both the wild type and humanized variants with anti-Human Serum Albumin NANOBODY building block are able to bind to RANK-L and albumin simultaneously.

12.4 Epitope Mapping of RANKL13hum5 and RANKL18hum6.

In the past, experimental data were generated which supported the statement that RANKL13hum5 and RANKL18hum6 bind to overlapping epitopes. This observation was confirmed in a BIACORE experiment. In these epitope mapping experiments the RANKL sensor chip was first saturated with the first NANOBODY (concentration of 500 nM). After 120 seconds, dissociation was allowed or a mixture containing the same concentration of the first NANOBODY together with 500 nM of the NANOBODY to be tested was injected for 120 seconds. In FIG. 9 the sensorgrams for RANKL18hum6 and in FIG. 10 the sensorgrams for RANKL13hum5 are shown. Only a slight increase in signal was observed upon injection of the mixture after saturation of the surface first with either RANKL13hum5 or RANKL18hum, indicating that RANKL13hum5 and RANKL18hum6 bind to overlapping epitopes.

12.5 Inhibition of RANK-L Induced Differentiation of RAW264.7 Cells by Formatted Humanized NANOBODIES RAW264.7 cells (ATCC) were maintained in DMEM containing 10% FBS. Cells were resuspended in alphaMEM without phenol red containing 10% FBS, 0.1% sodium pyruvate, 1% non essential amino acid and seeded at 2000 cells/well in a 96-well plate. A dilution series of the formatted humanized NANOBODIES was added to the wells. Differentiation to osteoclast-like cells was induced by adding 7.5 ng/mL RANKL (Peprotech, Rocky Hill, N.J.). The total tartrate-resistant phosphatase activity was measured in the supernatant after 4 days using paranitrophenylphosphate as substrate (FIG. 11).

12.6 Inhibition of RANK-L Interaction with RANK by Formatted Humanized NANOBODIES 96-well microtiter plates were coated overnight at 4° C. with anti-Fc NANOBODY PMP02 and blocked with Superblock T20 (PBS) blocking buffer. Different concentrations of formatted humanized NANOBODIES were preincubated with 200 ng/mL RANK-Fc and 5 ng/mL RANK-L after which the mixtures were transferred to the coated wells. Bound RANK-L was detected for 1 h at room temperature (RT) with a 1/100 dilution of Human TRANCE/RANKL/TNFSF11 Biotinylated Affinity Purified polyclonal antibody (R&D systems, Minneapolis, Minn.) in PBS containing 10% Superblock T20 (PBS) blocking buffer followed by a 30 min incubation with horseradish peroxidase labeled streptavidin (1/5000 in PBS containing 10% Superblock T20 (PBS) blocking buffer). Visualisation was performed with 3,3',5, 5'-tetramethylbenzidine (TMB) and hydrogen peroxide after which the coloring reaction was stopped with 1N HCl. The absorbance was determined at 450 nm. The inhibition of the RANK-L interaction with RANK by the formatted humanized NANOBODIES is shown in FIG. 12.

12.7 Binding of RANKL008a to Human Serum Albumin 96-well microtiter plates were coated overnight at 4° C. with human serum albumin (HSA, 20 µg/mL in PBS). Wells were aspirated and blocked with Superblock T20 (PBS) blocking buffer. Wells were incubated for 1 h at RT with a dilution series of RANKL008a. Subsequently, bound RANKL008a was detected with a bivalent NANOBODY coupled to horseradish peroxidase. Visualisation was performed as described above (FIG. 13).

12.8 Bifunctional Binding of RANKL008a to HSA and RANK-L

Two different ELISA formats were applied to measure a simultaneous binding of RANKL008a to HSA and RANK-L.

In a first format, 96-well microtiter plates were coated overnight at 4° C. with neutravidin (2 µg/mL, PBS) and blocked with Superblock T20 (PBS) blocking buffer. Wells were incubated with biotinylated RANK-L (0.5 µg/mL in PBS) after which a dilution series of RANKL008a was applied. Bound RANKL008a was detected with horseradish peroxidase labeled albumin (Genetex, San Antonio, Tex.; 1/6000). Visualisation was performed as described above (FIG. 14-A).

In a second format, 96-well microtiter plates were coated overnight at 4° C. with HSA (10 µg/mL, PBS) and blocked with Superblock T20 (PBS) blocking buffer. Subsequently, a dilution series of RANKL008a was applied. After 1 h incubation at RT, bound RANKL008a was detected with biotinylated RANK-L (5 ng/mL), followed by an incubation with horseradish peroxidase labeled streptavidin (1/2000). Visualisation was performed as described above (FIG. 14-B).

Example 13

Pharmacokinetics of Formatted Humanized NANOBODIES in Balb/c Mice after a Single Intravenous or Subcutaneous Administration A bolus dose of 100 µg of each NANOBODY was administered to male Balb/c mice (8 to 12 weeks) (n=3), either intravenously into the tail or subcutaneously. At a series of time points, blood samples were collected.

Detection of the different NANOBODIES was performed as follows: Maxisorb microtiter plates (Nunc, Wiesbaden, Germany) were coated for 1 hr at room temperature (RT) with 100 µl of a 5 µg/ml solution of Neutravidine (Pierce, Rockford, Ill.) in PBS buffer. After coating, the plates were aspirated for 4 seconds and blocked (300 µl/well) for 30 min at RT with Superblock T20 (Thermo Scientific Pierce Protein Research Products, Rockford, Ill.). Plates were washed three times with PBS containing 0.05% TWEEN20. After blocking, biotinylated human RANKL (0.25 µg/ml, 100 µl/well) was captured for 1 hr at RT (600 rpm). Dilution series of the NANOBODY standards (prepared in PBS/0.1% casein) were spiked into 100% pooled blank mouse serum (Harlan, Oxon, United Kingdom) and were then further diluted 1/10 with PBS containing 0.1% casein (in separate non-coated plate Nunc), resulting in a final sample matrix consisting of 10% pooled mouse serum. Serum samples were treated in the same way. All pre-dilutions were incubated for 30 minutes at RT (600 rpm) in the non-coated plate. After the capturing step, the coated plates were washed three times (PBS containing 0.05% TWEEN20), and an aliquot of each sample dilution (100 µl) was transferred to the coated plate and allowed to bind for 1 hr at RT (600 rpm). After sample incubation, the plates were washed three times (PBS containing 0.05% TWEEN20) and incubated for 1 hr at RT with 100 µl of an in-house polyclonal rabbit anti-NANOBODY antibody (1 µg/ml, in PBS/0.1% casein). The plates were then washed three times (PBS containing 0.05% TWEEN20) and incubated with 100 µl of a 1/2000 dilution (in PBS with 0.1% casein) of goat anti-rabbit HRP (DakoCytomation, Glostrup, Denmark). After incubation for 30 minutes at RT (600 rpm), plates were washed three times (PBS containing 0.05% TWEEN20) and incubated for 10 minutes in the dark with 100 µl of es(HS)TMB (1/3 dilution in HRP Buffer; SDT, Brussels, Belgium). After 10 minutes, the reaction was stopped with 100 µl HCl (1N). After 5 minutes, the absorbance of each well was measured at 450 nm (Tecan Sunrise spectrophotometer; Männedorf, Switzerland), and corrected for background absorbance at 620 nm. Concentration in each serum sample was determined based on a sigmoidal standard curve with variable slope.

After iv administration, the serum concentration-time profile of each mouse was subjected to a two-compartmental pharmacokinetic analysis using the pre-programmed Model number 7 within WinNonlin Professional Software Version 5.1 (Pharsight Corporation, Mountain View Calif., USA). Calculated parameters for the individual NANOBODIES are shown in Table C-17.

After sc administration, the serum concentration-time profile of each mouse was subjected to a one-compartmental pharmacokinetic analysis (with first order absorption) using the pre-programmed Model number 3 (no lag time) or 4 (with lag time) within WinNonlin Professional Software Version 5.1 (Pharsight Corporation, Mountain View Calif., USA). Calculated parameters for the individual NANOBODIES are shown in Table C-18.

Example 14

Pharmacokinetics and Pharmacodynamics of Formatted Humanized NANOBODIES in Cynomolgus Monkeys Female cynomolgus monkeys were assigned to 17 groups, each group consisting of three individuals aged approximately 24 months.

Animals were dosed as described in Table C-19. NANOBODIES RANKL008a, RANKL001p and RANKL003p were administered at different doses (3 mg/kg; 0.3 mg/kg; 0.03 mg/kg). NANOBODY ALB-8 served as a negative control. Small molecule Ibandronate was included as a positive control. Serum samples were taken for determination of the NANOBODY levels, antibody analysis, and analysis of the bone turnover marker serum N-telopeptide (serum N-Tx).

14.1 Pharmacokinetics

Concentrations of RANKL008a were determined in plasma as follows: 96-well microtiter plates (Maxisorp, Nunc, Wiesbaden, Germany) were coated overnight at 4° C. with 100 µL neutravidin (2 µg/mL, Pierce, Rockford, Ill.). Wells were aspirated and blocked for 30 min at RT with 300 µL SuperBlock®T20 PBS (Pierce, Rockford, Ill.). After 3 washing steps with PBS-0.05% TWEEN20, biotinylated RANKL (0.5 g/mL in PBS-0.1% casein-0.05% TWEEN20, in-house) was captured by incubating 100 µL for 1 hr at RT while shaking at 600 rpm. After this incubation step, wells were washed 3 times with PBS-0.05% TWEEN20. The standards, QC and predilutions of the test samples were prepared in a non-coated (polypropylene) plate in 100% Cynomolgus monkey plasma and incubated for 30 min at RT while shaking at 600 rpm. A 1/10 dilution of the samples in PBS-0.1% casein-0.05% TWEEN20 (final concentration of Cynomolgus monkey plasma is 10%) was transferred to the coated plate and incubated for 1 h at RT while shaking at 600 rpm. After three washing steps with PBS-0.05% TWEEN20, the plates were incubated with the purified in-house rabbit anti-NANOBODY polyclonal antibody (1 µg/mL in PBS-0.1% casein-0.05% TWEEN20, in-house, Batch No. 15/05/06) for 1 hr at RT while shaking at 600 rpm. After 3 washing steps with PBS-0.05% TWEEN20, 100 µl horse radish peroxidase (HRP) labeled polyclonal goat anti-rabbit (1/5000 in PBS-0.1% casein-0.05% TWEEN20, DakoCytomation, Glostrup, Denmark; Article No. P0448) was incubated for 1 h at RT while shaking at 600 rpm. Visualization was performed covered from light for 10 min with 100 µL 3,3',5,5'-tetramethylbenzidine (esTMB, SDT, Brussels, Belgium). This substrate was 1/3 diluted in substrate buffer. The substrate buffer is a composition of 60% $Na_2HPO_2$ (100 mM) and 40% citric acid (100 mM). After 10 min, the colouring reaction was stopped with 100 µL 1N HCl. The absorbance was determined at 450 nm after a 10 sec shake in the Tecan ELISA reader, and corrected for background absorbance at 620 nm. Concentration in each sample was determined based on a sigmoidal standard curve.

Concentrations of RANKL001p and RANKL003p were determined as follows: 96-well microtiter plates (Maxisorp, Nunc, Wiesbaden, Germany; Article No. 430341) were coated overnight at 4° C. with 100 µL neutravidin (2 µg/mL, Pierce, Rockford, Ill.). Wells were aspirated and blocked for 30 min at RT with 300 µL SuperBlock®T20 PBS (Pierce, Rockford, Ill.). After 3 washing steps with PBS-0.05% TWEEN20, biotinylated RANKL (0.5 µg/mL in PBS-0.1% casein-0.05% TWEEN20, in-house) was captured by incubating 100 µL for 1 hr at RT while shaking at 600 rpm. After this incubation step, wells were washed 3 times with PBS-0.05% TWEEN20. The standards, QC and predilutions of the test samples were prepared in a non-coated (polypropylene) plate in 100% Cynomolgus monkey plasma and incubated for 30 min at RT while shaking at 600 rpm. A 1/10 dilution of the samples in PBS-0.1% casein-0.05% TWEEN20+10% Cynomolgus monkey plasma (final concentration of Cynomolgus monkey plasma was 10%) was transferred to the coated plate and incubated for 1 h at RT while shaking at 600 rpm. After three washing steps with PBS-0.05% TWEEN20, the plates were incubated with the purified in-house rabbit anti-NANOBODY polyclonal antibody (1 µg/mL in PBS-0.1% casein-0.05% TWEEN20, in-house) for 1 hr at RT while shaking at 600 rpm. After 3 washing steps with PBS-0.05% TWEEN20, 100 µl horse radish peroxidase (HRP) labeled polyclonal goat anti-rabbit (1/2000 in PBS-0.1% casein-0.05% TWEEN20, DakoCytomation, Glostrup, Denmark) was incubated for 1 h at RT while shaking at 600 rpm. Visualization was performed covered from light for 10 min with 100 µL 3,3',5,5'-tetramethylbenzidine (undiluted esTMB, SDT, Brussels, Belgium). After 10 min, the colouring reaction was stopped with 100 µL 1N HCl. The absorbance was determined at 450 nm after a 10 sec shake in the Tecan ELISA reader, and corrected for background absorbance at 620 nm. Concentration in each sample was determined based on a sigmoidal standard curve.

Individual plasma concentration-time profiles of all monkeys were subjected to a non-compartmental pharmacokinetic analysis (NCA) using WinNonlin Professional Software Version 5.1 (Pharsight Corporation, Mountain View Calif., USA). The pre-programmed Model 200 or 201 was used after subcutaneous and intravenous dosing respectively. The AUC and derived PK-parameters were calculated by means of the linear-up/log down trapezoidal rule. An overview of the calculated pharmacokinetic parameters is presented in Tables C-20 to C-23.

14.2 Pharmacodynamics

Changes in bone resorption induced by the NANOBODIES were assessed by assaying serum NTx using immunoassays according to manufacturer's instructions (Osteomark® NTx serum, Wampole Laboratories).

FIGS. 15 and 16 represent the serum NTx concentration-time plots for the different NANOBODIES dosed at different amounts either intravenously or subcutaneously.

All plasma concentration-time profiles of each NANOBODY were fitted simultaneously to the pharmacokinetic function that was minimally necessary to provide a reasonable characterization of the concentration-time data. Only the plasma concentration-time profiles of the monkeys devoid of significant immunogenicity were included in the analysis. A two-compartmental pharmacokinetic model with both linear and non-linear clearance from the central compartment was found to characterize the dose and time dependent pharmacokinetics. In turn, these NANOBODY-specific pharmacokinetic functions were used as an input function for the pharmacodynamic model to estimate the in vivo potency ($IC_{50}$) and intrinsic activity ($I_{max}$) on serum NTx turnover.

The intrinsic activity ($I_{max}$) and potency ($IC_{50}$) of each NANOBODY on the serum NTx turnover was described using an indirect response model. The indirect response model was parameterized with the half-life of serum NTx ($t_{1/2}=0.693/k_{out}$) and a NANOBODY-mediated inhibition (Hill function) on the zero order production rate of NTx ($K_{in}$). The NANOBODIES were assumed to inhibit $K_{in}$ by means of a Hill equation parameterized with $I_{max}$, $IC_{50}$ and a shape factor n. For each NANOBODY a single set of PD parameters was estimated, except for RANKL003p where the turnover parameters ($K_{in}$, $K_{out}$) were allowed to vary for each dose level.

The obtained pharmacodynamic parameters of all NANOBODIES are presented in Table C-24. Although all three NANOBODIES had similar intrinsic activity and mediated an almost complete inhibition of serum NTx ($I_{max}\approx90$), their potency was significantly different. RANKL008a was found to be the most potent inhibitor of serum NTx synthesis, followed by RANKL001p and RANKL003p. RANKL003p had a tenfold lower potency than RANKL008a. The average serum NTx half-life was approximately 1.6 hr.

Example 15

Cross-Reactivity of RANKL 130, RANKL180, RANKL008a, RANKL001p and RANKL003p with TNF Family Members TNFα, CD40 Ligand (CD40L) and TRAIL The cross-reactivity of the anti-RANK-L NANOBODIES with TNF family members TNFα, TRAIL or to mouse RANK-L was tested in a competition ELISA. Human RANK-L was coated on 96-well plates as described in Example 2. NANOBODIES (100 pM) were preincubated with varying concentrations of human RANK-L, mouse RANK-L, TNFα or TRAIL (10 nM down to 13.7 pM) before they were added to the plates. Binding of the NANOBODIES to the RANK-L coated plates was only inhibited by exogenously added RANK-L and was not affected by the addition of the other ligands (FIG. 17).

Example 16

Administration of Anti-RANK-L NANOBODIES Prevents Bone Loss and Maintains Strength and Quality in Ovariectomized Cynomolgus Monkeys Osteoporosis is characterized by low bone mass and microarchitectural deterioration of bone tissue, with a consequent increase in fragility and susceptibility to fractures. Estrogen depletion contributes to the low bone mass characteristic of postmenopausal osteoporosis. Therefore, estrogen depletion has been used as a bone loss animal model for studying osteoporosis therapies One month after OVX or sham surgery, ovariectomized (OVX) cynomolgus monkeys (cynos) (9 to 16 years old) are treated with vehicle or anti-RANK-L NANOBODY for 16 months. Sham controls are treated with vehicle. Effects on bone resorption and on bone mineral density (BMD) upon administration of the anti-RANK-L NANOBODY are analysed.

After sacrifice, ex vivo DXA and pQCT scans are taken of the intact right femur, L3-L4 vertebral bodies, and L5-L6 vertebral 5 mm cancellous cores. Destructive testing is performed by 3-point bending of the femur diaphysis and humeral cortical beams, shearing of the femur neck, and compression of the lumbar vertebral specimens.

The effects of the anti-RANK-L NANOBODY on bone turnover at the histologic level, and their relationships with bone strength are analysed as follows: Double fluorochrome labels are injected prior to iliac and rib biopsies (at month 6 and 12), and prior to sacrifice. Histomorphometry is performed on these biopsies, the tibial diaphysis, and cancellous bone in L2 vertebra and the proximal femur.

Example 17

Construction and Analysis of VHH-Fc Fusions

NANOBODIES directed against RANK-L are cloned in a suitable vector to generate genetic fusions to the CH1 deleted Fc portion of human IgG1 or of human IgG2. The hinge regions linking the NANOBODY to Fc are derived either from IgG1 or IgG2.

Plasmid constructs are transfected in eukaryotic cell lines and Fc fusion is secreted into the culture supernatant. Products are purified and analysed on a Coomassie stained gel. Representative sequences are depicted in Table B-6 (SEQ ID NO's: 774-789). NANOBODY-fusions are tested in FMAT competition binding assay, NF-κB reporter assay and TRACP 5b osteoclast differentiation assays.

Example 18

Cross-Reactivity of RANKL008a with TNF Family Members TNF-α, TRAIL, FasL, CD40L, LTα1/β2, LTα2/β1 and LIGHT In order to identify human proteins that share sequence similarity with RANK-L, its protein sequence (Genbank accession number CAM23721) was used to search the translated human genome with TBLASTN using the standard settings (BLOSUM62). For the highest scoring sequences, the region corresponding to the CD-loop was compared to RANK-L to assess possible binding of RANKL008a.

Cross-reactivity of RANKL008a with selected TNF family members was tested via competition ELISA. Ninety six-well microtiter plates (Nunc, Maxisorp) were coated ON at 4° C. with 100 µL of 2 µg/mL neutravidin (Pierce) in PBS. Wells were aspirated and blocked with 300 µL of SuperBlock T20 PBS blocking buffer (Pierce) for 30 min at RT. Wells were washed thrice with 0.05% PBS-TWEEN, and subsequently incubated with 0.05 µg/mL biotinylated sRANK-L diluted in PBS-TWEEN for 1 h at RT and 600 RPM. In the mean time, 3.27 ng/mL of RANKL008a was preincubated with a dilution series of TNF receptor family members (RANK-L, TNF-α, TRAIL, FasL, CD40L, LTα1/β2, LTα2/β1 and LIGHT) for 1 h at RT and 600 RPM. The sRANK-L-containing wells were washed 3 times with PBS-TWEEN and 100 µL of the pre-incubated RANKL008a samples was transferred to the coated plate. After 1 h incubation at RT and 600 RPM, bound RANKL008a was detected for 30 min at RT and 600 RPM with 100 µL of polyclonal rabbit anti-VHH R23 (1 µg/mL in PBS-TWEEN, Ablynx). The wells were washed as above and incubated for 30 min at RT and 600 RPM with HRP-conjugated polyclonal goat anti-rabbit Ig (0.15 µg/mL in PBS-TWEEN, DakoCytomation). Visualisation was performed with esTMB for 7 min, after which the reaction was stopped with 1N HCl. The absorbance was determined at 450 nm.

Binding of the NANOBODIES to the plates was only inhibited by exogenously added unlabeled RANK-L and was not affected by the addition of the other ligands (FIG. 18).

Example 19

RANKL-Mediated Differentiation of CD14+ Monocytes

Peripheral Blood Mononuclear cells (PBMCs) were purified from human buffy coats using Ficoll Paque. CD14+ monocytes were isolated using CD14 Microbeads (Miltenyi Biotec) according to the manufacturer's instructions. The CD14+ cell fraction and the CD14− fraction (i.e. the effluent during the separation procedure; cells not attached to the anti-CD14 beads) were seeded at 100.000 cells/well in a 96-well culture plate in αMEM culture medium without phenol red containing 10 vol % FBS, 0.1 vol % penicillin/streptomycin, 0.1 vol % sodium pyruvate and 1 vol % non essential amino acids. After 2 hours incubation at 37° C. and 5% $CO_2$, NANOBODIES were added and differentiation was induced with 7.5 ng/mL recombinant human RANKL and 50 ng/mL human Macrophage colony-stimulating factor (MCSF). Cells were cultured for 11 days and 50 vol % of the culture medium was replaced every 2 days by fresh medium. Differentiation was assessed by cytochemical staining for intracellular TRACP performed after fixation in 3.7% formaldehyde in acetone using the Leukocyte Acid Phosphatase kit (Sigma). Moreover, TRACP 5b isoform activity in the culture medium was performed using the BONETRAP® assay (Immunodiagnostic Systems) according to the manufacturer's instructions.

RANKL008a completely blocked RANKL-mediated differentiation of CD14+ monocytes to osteoclasts. Indeed, in the presence of effective concentrations of RANKL008a, RANKL-induced intracellular TRACP staining was inhibited (FIG. 19). Moreover, RANKL-induced TRACP5b activity in conditioned medium was completely blocked (FIG. 20). In the absence of RANKL or MCSF, baseline TRACP5b activity was measured, as expected.

Example 20

Inhibition of Membrane RANKL (mRANKL) Interaction with RANK-Fc

Interaction of mRANKL with RANK was measured using a cell adhesion assay. For this purpose, Chinese Hamster Ovary (CHO) cells which are expressing recombinant membrane-bound human RANKL were used. Cells were maintained in RPMI containing Glutamax, 25 mM Hepes and 10 vol % FBS.

96-well white polystyrene plates (Corning) were immobilized with the anti-Fc NANOBODY PMP02 (5 μg/mL in sodium bicarbonate buffer pH 9.6). Wells were blocked with PBS containing 3% BSA for 1 h at RT and washed with PBS. Cells were detached with non-enzymatic dissociation buffer and resuspended in RPMI1640 medium. After 30 min incubation at RT of cells (400.000/mL) with 500 ng/mL RANK-Fc in the presence or absence of NANOBODIES or controls, the mixtures were transferred to the coated wells. After 2 h incubation at RT, wells were washed once with PBS and adhered cells were visualized using the luminescent-based CellTiter Glo® reagent for cell viability (Promega) according to the manufacturer's instructions.

RANKL008a could concentration-dependently and completely block the interaction of mRANKL with RANK-Fc (FIG. 21). A clear shift in potency was observed for CabLys3-Alb11-13H5 (SEQ ID NO: 815) compared to RANKL008a, while 13H5-CabLys3-13H5 (SEQ ID NO: 816) displayed similar activity.

Example 21

Inhibition of mRANKL Mediated Osteoclast Differentiation

Osteoclast differentiation mediated by mRANKL was investigated using a coculture assay in which RAW264.7 cells were stimulated with recombinant membrane bound human RANKL expressed on CHO cells. RAW264.7 cells and CHO cells were maintained as described above. CHO cells were detached using non-enzymatic dissociation buffer and resuspended in RPMI1640 containing 10 vol % FBS and 1 vol % penicillin/streptomycin. CHO cells were seeded at a density of 20.000 cells/well in a 96-well microtiter plate and incubated for 24 h at 37° C. and 5% $CO_2$. Cells were washed 3 times with PBS and subsequently fixed in a solution of 3.7% paraformaldehyde in PBS. A dilution series of NANOBODIES or controls was added to the wells. Subsequently, wells were incubated with RAW264.7 cells for 5 days at 37° C., 5% $CO_2$ and at a density of 2000 cells/well in αMEM culture medium without phenol red containing 10 vol % FBS, 0.1 vol % penicillin/streptomycin, 0.1 vol % sodium pyruvate and 1 vol % non essential amino acids. Differentiation was assessed by either cytochemical staining for intracellular TRACP or TRACP activity measurements in the conditioned medium as described above (FIGS. 22 and 23).

Example 22

Pharmacokinetics and Pharmacodynamics of RANKL008a Vs. αOPGL-1 in Cynomolgus Monkeys RANKL008a was expressed in *Pichia pastoris* and purified on SP Sepharose as a capturing step and a Q filter as a polishing step or on SP Sepharose as a capturing step and Capto MMC as a polishing step (GE Healthcare Life Sciences). Concentration of the NANOBODY and buffer switch to PBS was done via UF/DF (Sartorius Hydrosart Sartocon Slice 200, 10 kDa). A final filtration was carried out at 0.22 μm.

The amino acid sequence of the monoclonal antibody αOPGL-1 is described in SEQ ID NO's: 2 and 4 of US2004/0033535. αOPGL-1 was expressed in CHO-K1SV cells (Lonza) and purified on MabSelect Sure as a capturing step and Source30S as a polishing step (GE Healthcare Life Sciences).

Female Cynomolgus monkeys (3 animals per test compound) received a single i.v. bolus administration of RANKL008a at 0.3 mg/kg or αOPGL-1 at 1 mg/kg. An additional three female monkeys were dosed with PBS and served as negative control.

Blood samples were processed to plasma for determination of the NANOBODY levels and antibody analysis. In addition, blood samples were collected and processed to serum for the analysis of the bone turnover marker serum N-telopeptide (serum N-Tx).

22.1 Bioanalytical determination of RANKL008a and αOPGL-1
22.1.1 Determination of RANKL008a plasma concentrations Plasma concentrations of RANKL008a were determined in plasma using a RANKL-independent ELISA. In short, 96-well microtiter plates (Maxisorp, Nunc, Article No. 430341) were coated overnight at 4° C. with 100 μl of an in-house made anti-NANOBODY NANOBODY at a concentration of 3 μg/ml in bicarbonate buffer (15 mM $Na_2CO_3$, 35 mM $NaHCO_3$, pH9.6). Wells were aspirated and blocked for 30 min at room temperature (RT) with 300 μl SuperBlock®T20 (PBS) (Pierce, Article No. 37516, Lot#JG121073). The standard curve stock solution and the QC samples were prepared in a low adhesion plate (Nunc Article No. 24994) in 100% pooled Cynomolgus plasma (Sera Laboratories International; SLI#FF109188/209188; catalog#PSCIM-118-M; aliquoted on 3 Oct. 2008) and incubated for 1 h at RT while shaking at 600 rpm. A 1/20 dilution of the standard stock solution, QCs and test samples were made in PBS/0.1% casein (resulting in a 5% final plasma concentration). Further dilutions of the calibrators and test samples were made in PBS/0.1% casein supplemented with 5% plasma. After the 1/20 dilution, test samples were further diluted in order to bring them into the dynamic range. The 5% plasma solutions were incubated at RT and 600 rpm for 30 minutes. 100 μl/well was transferred to the coated and blocked plate and incubated for 2 hr at RT while shaking at 600 rpm. The plates were washed 3 times with PBS/0.05% TWEEN20. 100 μl of an in-house made anti-NANOBODY NANOBODY at 250 ng/ml in PBS/0.1% casein was added per well and plates were incubated for 1 h at RT while shaking at 600 rpm. Plates were washed 3 times with PBS/0.05% TWEEN20. 100 μl strep-HRP (1/10000 in PBS/0.1% casein, Dako: P0397; Batch no 00032671) was added per well and plates were incubated for 30 min at RT while shaking at 600 rpm. Again, plates were washed 3 times with PBS/0.05% TWEEN20 and 100 µl of the 3,3',5,5'-tetramethylbenzidine substrate (es(HS)TMB (SDT-reagents)) 1/3 diluted in substrate buffer (HRP buffer: 60% 100 mM $Na_2HPO_4.2H_2O$, 40% citric acid, pH 4.3)) was added per well. The colouring reaction was allowed to proceed for 15 minutes at RT in the dark, after which the reaction was stopped by adding 100 µl 1N HCl per well. The absorbance was determined at 450 nm after a 10 seconds shake in the Tecan ELISA reader, and corrected for background absorbance at 620 nm. The concentration in each sample was determined based on a 4 parameter logistic fit of the standard curve.

The assay was validated and assay range was verified to be between 25 to 600 ng/ml on plasma level. All samples were analysed in duplicate and a reported value was generated by calculating an average concentration from the replicates from the lowest dilution factor. All assays generating a reported value passed the 4/6/20 rule on freshly prepared QC samples (% bias and % CV of 4 out of 6 QC samples should be ≤20% with least 50% of the QC samples passing this criterion at each concentration level). If the 4/6/20 rule was not met or the % CV of the duplicate study samples was >20%, no reported value was generated and the samples were re-analyzed. Incurred sample re-analysis, performed on 10% of the study samples showed that reported values did not differ more than 30% upon re-analysis.

22.1.2 Determination of αOPGL-1 Plasma Concentrations

Plasma concentrations of αOPGL-1 were determined using ELISA as described below.

96-well microtiter plates (Maxisorp, Nunc, Article No. 430341) were coated overnight at 4° C. with 100 µl neutravidin (Thermo Scientific, Prod#31000, Lot#JC122585, stock conc: 2 mg/ml) at a concentration of 2 µg/ml in PBS (Phosphate buffered saline). Wells were aspirated and blocked for 30 min at room temperature (RT) with 300 µl PBS/1% casein (casein: Calbiochem; catalog nr: 218682). Afterwards plates were washed 3 times with PBS/0.05% TWEEN20 and 100 µl biotinylated RANKL (Peprotech, Cat#310-01; biotinylated in-house) was added per well. The plates were incubated for 1 h at RT while shaking at 600 rpm. The standard curve stock solution and the QC samples were prepared in a low adhesion plate (Nunc Article No. 24994) in 100% pooled Cynomolgus plasma (Sera Laboratories International; SLI#FF109188/209188; catalog#PSCIM-118-M; aliquoted on 3 Oct. 2008) and incubated for 1 h at RT while shaking at 600 rpm. A 1/20 dilution of the standard stock solution, QCs and test samples was made in PBS/0.1% casein (resulting in a 5% final plasma concentration). Further dilutions of the calibrators and test samples were made in assay diluents (PBS/0.1% casein supplemented with 5% plasma). If needed, test samples were further diluted to bring them into the dynamic range of the assay. The 5% plasma solutions were incubated at RT and 600 rpm for 30 minutes. 100 l/well was transferred to the bio-RANKL containing plate and incubated for 2 h at RT while shaking at 600 rpm. The plates were washed 3 times with PBS/0.05% TWEEN20. 100 µl of rabbit anti-human IgG-HRP (Dako; P0214; Lot#012(101); 1/20000 in PBS/0.1% casein) was added per well and plates were incubated for 1 h at RT while shaking at 600 rpm. Plates were washed 3 times with PBS/0.05% TWEEN20 and 100 µl of the 3,3',5,5'-tetramethylbenzidine substrate (ES TMB (SDT-reagents) 1/3 diluted in substrate buffer (60% 100 mM $Na_2HPO_4.2H_2O$, 40% citric acid, pH 4.3)) was added per well. The colouring reaction was allowed to proceed for 15 minutes at RT in the dark, after which the reaction was stopped by adding 100 µl 1N HCl per well. The absorbance was determined at 450 nm after a 10 seconds shake in the Tecan ELISA reader, and corrected for background absorbance at 620 nm. The concentration in each sample was determined based on a 4 parameter logistic fit of the standard curve.

The assay was validated and the assay range was verified to be between 60 to 800 ng/ml on plasma level. All samples were analysed in duplicate and a reported value was generated by calculating an average concentration from the replicates from the lowest dilution factor. All assays generating a reported value passed the 4/6/25 rule on freshly prepared QC samples (% bias of 4 out of 6 QC samples should be ≤25% with least 50% of the QC samples passing this criterion at each concentration level). If the 4/6/25 rule was not met or the % CV of the duplicate study samples was >20%, no reported value was generated and the samples were re-analyzed. Incurred sample re-analysis, performed on 10% of the study samples showed that reported values did not differ more than 30% upon re-analysis.

22.2 Determination of Anti-Drug Antibodies 22.2.1 Determination of Anti-Drug Antibodies Against RANKL008a in the Plasma of the Cynomolgus Monkeys Cynomolgus monkey plasma was screened for anti-drug antibodies against RANKL008a and its building blocks as described below.

Selected monkey plasma samples at predose and at various time points after RANKL008a administration were screened for the presence of anti-drug antibodies using an ELISA-based direct detection titration assay. 96-well microtiter plates (Maxisorp, Nunc, Article No. 430341) were coated overnight at 4° C. with either RANKL008a (*Pichia* produced as described above; 1.42 mg/ml), the RANKL13H5 building block or the Alb8 building block, each at a concentration of 5 µg/mL in bicarbonate buffer (15 mM $Na_2CO_3$ (1.59 g/l)+35 mM $NaHCO_3$ (2.93 g/l) in 1l, pH 9.6) (100 µL per well). Wells were aspirated and blocked for 30 minutes at room temperature (RT) with 300 µL SuperBlock®T20 (PBS) (Pierce, Article No. 37516, Lot#JG121073). Afterwards plates were washed 3 times with PBS/0.05% TWEEN20. Plasma test samples and positive controls (plasma collected from Cynomolgus monkey with positive response to NANOBODY) were prepared in a low adhesion plate (Nunc Article No. 249944) by a first 1/50 dilution step, followed by a 1/3 dilution series in 6 steps in PBS/0.1% casein/0.05% TWEEN20. 100 l/well samples and controls were transferred to the coated plate and were allowed to bind for 1 h at RT while shaking at 600 rpm. Negative control for each plate was PBS/0.1% casein/0.05% TWEEN20 (buffer). The plates were washed 3 times with PBS/0.05% TWEEN20. 100 µL of Rabbit anti-Monkey IgG-Bio (1/5000 in PBS/0.1% casein/0.05% TWEEN20; Nordic Immunology; RAMon/IgG(H+L)/Bio (5086)) was added per well and plates were incubated for 30 min at RT while shaking at 600 rpm. Afterwards plates were washed 3 times with PBS/0.05% TWEEN20 and 100 µl streptavidin-HRP (1/5000 in PBS/0.1% casein/0.05% TWEEN20; Dako; P0397; Lotnr.00047645) was added per well. Plates were incubated for 30 min at RT while shaking at 600 rpm. Again, plates were washed 3 times with PBS/0.05% TWEEN20 and 100 µl of the 3,3',5,5'-tetramethylbenzidine substrate (ES TMB (SDT-reagents) 1/3 diluted in substrate buffer (60% 100 mM $Na_2HPO_4.2H_2O$, 40% citric acid, pH 4.3)) was added per well. The colouring reaction was allowed to proceed for 15 minutes at RT in the dark, after which the reaction was stopped by adding 100 µl 1N HCl per well. The absorbance was determined at 450 nm after a 10 seconds shake in the Tecan ELISA reader, and corrected for background absorbance at 620 nm.

The titer was determined as the highest dilution factor at which the OD level was above threshold. The threshold was defined as the mean of the negative controls multiplied by 2.

22.2.2. Determination of Anti-Drug Antibodies Against αOPGL-1 in the Plasma of the Cynomolgus Monkey Cynomolgus monkey plasma was screened for anti-drug antibodies against αOPGL-1 as described below.

Selected monkey plasma samples at predose and at various time points after αOPGL-1 administration were screened for the presence of anti-drug antibodies (IgG isotype) using an ELISA-based bridging assay. 96-well microtiter plates (Maxisorp, Nunc, Article No. 430341) were coated overnight at 4° C. with αOPGL-1 (at a concentration of 5 μg/mL in PBS (Phosphate-buffered saline) buffer (10 PBS tablets (Oxoid//BR0014G) per liter MQ) (100 μL per well). Wells were aspirated and blocked for 30 min at room temperature (RT) with 300 μL SuperBlock®T20 (PBS) (Pierce, Article No. 37516, Lot#JG121073). Afterwards plates were washed 3 times with PBS/0.05% TWEEN20. Plasma test samples were prepared in a low adhesion plate (Nunc Article No. 249944) by a 1/2 dilution step in PBS/0.1% casein. 100 μl/well samples were transferred to the coated plate and allowed to bind for 1 h at RT while shaking at 600 rpm. Negative control for each plate was PBS/0.1% casein (buffer). The plates were washed 3 times with PBS/0.05% TWEEN20. 100 μL of biotinylated αOPGL-1 at a concentration of 1 μg/mL in PBS/0.1% casein was added per well and plates were incubated for 30 min at RT while shaking at 600 rpm. Afterwards plates were washed 3 times with PBS/0.05% TWEEN20 and 100 μl streptavidin-HRP (1/5000 in PBS/0.1% casein; Dako; P0397; Lotnr.00047645) was added per well and plates were incubated for 30 min at RT while shaking at 600 rpm. Again, plates were washed 3 times with PBS/0.05% TWEEN20 and 100 μl of the 3,3',5,5'-tetramethylbenzidine substrate (ES TMB (SDT-reagents) 1/3 diluted in substrate buffer (60% 100 mM $Na_2HPO_4.2H_2O$, 40% citric acid, pH 4.3)) was added per well. The colouring reaction was allowed to proceed for 15 minutes at RT in the dark, after which the reaction was stopped by adding 100 μl 1N HCl per well. The absorbance was determined at 450 nm after a 10 seconds shake in the Tecan ELISA reader, and corrected for background absorbance at 620 nm.

22.3 Determination of Serum NTX Levels

For determination of the serum NTx levels in the serum of the Cynomolgus monkeys the Osteomark® NTx Serum kit (Wampole Laboratories, Princeton, N.J., USA) was used for the quantitative measure of cross-linked N-telopeptides of type I collagen (NTx) in serum, being an indicator for bone resorption.

This Osteomark® NTx Serum kit is a competitive-inhibition enzyme-linked immunosorbent assay (ELISA) in which a synthetic NTx epitope is adsorbed onto a 96-well microplate. Diluted samples are added to the microplate wells, followed by a horseradish peroxidase labeled monoclonal antibody. NTx in the sample competes with the NTx epitope coated to the wells of the microplate. Following a wash step, the amount of bound labeled antibody is measured by the colorimetric generation of a peroxide substrate. Absorbance is determined spectrophotometrically and NTx concentration calculated using a standard calibration curve with purified NTx antigen. Assay values are reported in nanomoles Bone Collagen Equivalents per liter (nM BCE).

22.4. Data Analysis 22.4.1 Pharmacokinetic Data Analysis

Descriptive statistics (mean and SD) were calculated per dose group and per sampling time point using Microsoft Excel 2007. In case all three values were below the quantification limit (BQL), BQL was reported. When one or two out of three values were BQL, BQL values were set to zero and the mean calculated.

Individual plasma concentration-time profiles were subjected to non-compartmental analysis (NCA) (Model 201; i.v. bolus injection) using WinNonlin Pro 5.1 (Pharsight Corporation, USA; 2006). The area under the curve (AUC) was estimated using the lin up/log down rule. LLOQ values were treated as missing, except when comprised between two values above the LLOQ, then they were set to zero. The concentration at time zero (CO) was estimated through back-calculation based on the two first data points. The terminal elimination half-life (t½) was calculated automatically (best-fit) using a log-linear regression of the non-zero concentration-time data of the log-linear portion of the terminal phase. A minimum of three points were considered for the determination of λz.

The following main pharmacokinetic parameters were estimated: plasma concentration at time zero (C0); the area under the plasma concentration-time curve extrapolated to infinity (AUCinf), total body clearance (CL), volume of distribution at steady-state (Vdss), and the dominant half-life ($t_{1/2}$).

22.4.2 Pharmacodynamic Data Analysis

Descriptive statistics (mean and SD) were calculated per dose group and per sampling time point using Microsoft Excel 2007.

Response parameters and associated statistics for the overall time course were calculated by noncompartmental analysis of the response-time data using WinNonlin Pro 5.1 (Pharsight Corporation, USA; 2006). The non-compartmental analysis was based on a model for pharmacodynamic data (Model 220). As threshold value 30% readout was considered. The following main pharmacodynamic parameters were determined: time below the threshold (Time below T), area under the threshold (AUC below threshold), time at which the serum NTx first drops below the threshold (tonset), and time at which the serum NTx first returns back above the threshold (toffset).

22.5 Results 22.5.1 Immunogenicity Evaluation

Immunogenicity was observed in all animals. However, in combination with PK and PD data, only one animal from the αOPGL-1 treated-animals displayed evident signs of immunogenicity, which likely have impacted the PK/PD data. This animal was therefore not considered in subsequent PK and PD analyses.

22.5.2 Pharmacokinetics

In FIG. 24, the mean plasma concentration time profiles of RANKL008a and αOPGL-1 following an single i.v. bolus administration at 0.3 mg/kg (RANKL008a) or 1 mg/kg (αOPGL-1), respectively in the female Cynomolgus monkey are presented.

After i.v. injection of RANKL008a, the plasma levels of RANKL008a dropped fairly rapidly up to about 1 day post-dose, corresponding to the distribution phase of the compound. Thereafter the drug levels dropped gradually with two distinct elimination phases. The dominant half-life was ca 8 days.

After i.v. injection of αOPGL-1, plasma concentrations of αOPGL-1 also dropped quite rapidly up to about 1 day post-dose, related to the distribution phase of the compound.

After the distribution phase, αOPGL-1 levels dropped more gradually with two distinct elimination phases. The half-life of the dominant phase was ca 6 days.

In Table C-25 the main pharmacokinetic parameters of RANKL008a and αOPGL-1 following an single i.v. bolus administration with RANKL008a at 0.3 mg/kg or αOPGL-1 at 1 mg/kg in the female Cynomolgus monkey are listed.

22.5.3 Pharmacodynamics

In FIG. 25, the temporal time profiles of serum NTx concentrations following a single i.v. bolus administration at 0.3 mg/kg (RANKL008a) or 1 mg/kg (αOPGL-1) in the female Cynomolgus monkey are shown.

The main pharmacodynamic parameters of RANKL008a and αOPGL-1 following a single i.v. bolus dose of RANKL008a at 0.3 mg/kg or αOPGL-1 at 1 mg/kg in the female Cynomolgus monkey are listed in Table C-26, Pharmacodynamic serum NTx sample analysis demonstrated that animals treated with the RANKL008a (0.3 mg/kg) or αOPGL-1 (1 mg/kg) displayed a rapid drop in serum NTx levels (mean T onset of 0.143 and 0.125 d, respectively in Table C-26). The maximum effect was observed at 8 d post-dose for RANKL008a and somewhat later (11 d post-dose) after αOPGL-1 administration. (Tmin values in Table C-26). After its maximum effect serum Ntx levels slowly returned to baseline. The time below the threshold (Time below T) was fairly comparable (RANKL008a: 19 d; αOPGL-1: 17 d) after dosing with RANKL008a (0.3 mg/kg IV) and αOPGL-1 (1 mg/kg IV). Animals administered with PBS also showed a small but transient drop in serum NTx levels. This drop was however never below the threshold value (30% of the baseline value) and was rather procedure related than a true test-item related effect.

Tables

TABLE B-1

Preferred Nanobodies against RANK-L (inhibitors of RANK/RANK-L interaction)

<Name, SEQ ID #; PRT (protein); ->
Sequence

>RANKL1 | 051_RANKL1c125 | 9B1, SEQ ID NO: 560; PRT; ->
EVQLVESGGGLVQAGGSLRLSCAVSGRTFSSSTMAWFRQPPGGERDFVASISTSGTRTLYADSVKGRFTISR
DNAKSTGYLQMNSLKPEDTAVYFCAAVNRRGWEFWRLASGYDYWGLGAQVTVSS

>RANKL2 | 051_RANKL2c15 | 2B9, SEQ ID NO: 561; PRT; ->
EVQLVESGGGLVQPGGSLRLSCAASGFTFSSYYMSWVRQAPGKGLEWVSSIYSDGSTTDYADSVKGRFTISR
DNAKNTLNLQMNSLKSEDTAVYYCAKDANSGGLEYDYWGQGTQVTVSS

>RANKL3 | 051_RANKL3c11 | 2G8, SEQ ID NO: 562; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSS

>RANKL4 | 051_RANKL4c123 | 4F12, SEQ ID NO: 563; PRT; ->
KVQLVESGGGLVQTGDSLRLSCAASGRAIGSYAMGWFRQAPGKEREFVAVINYRGSSLKYADRVKGRFTISR
DNAKNMVYLQMNSLKPDDTAVYYCAAQTSGADFGTTPQRYTYWGQGTQVTVSS

>RANKL5 | 051_RANKL5c110 | 4G8, SEQ ID NO: 564; PRT; ->
EVQLVESGGGLVQAGGSLRLSCAASGRTIGGHTMAWFRQAPGKERDFVATITSSGSTIFYADSVKGRFTISR
DNGKKTMTLEMDSLKPEDTAVYYCAARIRGKVTVDNFDYAYWGQGTQVTVSS

>RANKL6 | 051_RANKL6c18 | 4H9, SEQ ID NO: 565; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSS

>RANKL7 | 051_RANKL7c113 | 7B4, SEQ ID NO: 566; PRT; ->
EVQLVESEGGPVQSGGSLRLSCAASGRTFSVSTIAWFRQAPGEGREFVAAIYPSGRNAYVADSVKGRFTISR
DNAKKTVYLQMNSLKPEDTAAYYCAAHQPSGSYYSAEAYAYWGQGTQVTVSS

>RANKL8 | 051_RANKL8c128 | 7E, SEQ ID NO: 567; PRT; ->
EVQLVESGGGSVQPGGSLRLSCAASGGTFSRYAMGWFRQAPGKEREFVSAISVGGTYQYYVDSVKGRFTISR
DNAESTVYLQMNSLKPEDTAVYYCAGDASPYGYLREYTATRFDYWGQGTQVTVSS

>RANKL9 | 051_RANKL9c132 | 8A11, SEQ ID NO: 568; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSS

>RANKL10 | RANKLPMP9B3 | 9B3, SEQ ID NO: 569; PRT; ->
EVQLVESGGGLVQAGGSLRLSCAASGITFSSRTMGWFRQAPGKEREFVAAITPSSRTTYYADSVKGRFTISR
DNAKNTVLLQMNSLKPEDTAVYYCAAERTYGSNYTRPTAWNYWGQGTQVTVSS

>RANKL11 | 051_RANKL11c116 | 9F10, SEQ ID NO: 570; PRT; ->
EVQLVESGGSLVQAGGSLRLSCAASGRTFSSKTMGWFRQPPGNEREFVAAITPTSRTTYYADSVKGRFTISR
DNAKNTVSLQMNSLKFEDTAAYYCVAVRRYGSPPHDGSSYEYWGQGTQVTVSS

>RANKL12 | 051_RANKL12c11 | 9B6, SEQ ID NO: 571; PRT; ->
EVQLVESGGGWMQAGGSLRLSCAASGRTFTMAWFRQAPGKEREFVAAITGSGRSTYYTDSVKGRFTISRDNA
KNTAYLQMKSLKPEDTAVYYCAGLRGLGLEYDSAKSYSYWGQGTQVTVSS

>RANKL13 | 051_RANKL13c11 | 1C7, SEQ ID NO: 572; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSS

TABLE B-1-continued

Preferred Nanobodies against RANK-L (inhibitors of RANK/RANK-L interaction)

<Name, SEQ ID #; PRT (protein); ->
Sequence

>RANKL14 | 051_RANKL14c11 | 6B8, SEQ ID NO: 573; PRT; ->
EVQLVESGGGLVQAGGSLRLSCAASGRTSSYYTMSWFRQDPGKEREFVAAVPLSGNTYYADPVRGRFTISRD
NAKNTADLQMNSLKPEDTAVYYCAARASGSIYNRGSYAYWGQGTQVTVSS

>RANKL15 | 051_RANKL15c11 | 7C5, SEQ ID NO: 574; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSS

>RANKL15 | 051_RANKL16c11 | 7G8, SEQ ID NO: 575; PRT; ->
EVQLVESGGGLVQAGGSLRLSCVASRRTFSSYAMGWFRQVPGKERDFVAAISTGSITIYGDSVKGRFTISRD
NAKNTVYLQMNSLKPEDTAVYYCAAGKREPYLRQYTASNPYDYWGQGTQVTVSS

>RANKL17 | 051_RANKL17c11 | 9C2, SEQ ID NO: 576; PRT; ->
EVQLVESGGGLVQVGDSLRLSCEASGRSRFSTYVMGWFRQAPGKEREFVAAVSWSSGNAYYIDSAKGRFATS
RDTAKNIMYLQMNSLKPEDTAVYTCAAGRGYGLLSEYTQAPRYDYWGQGTQVTVSS

>RANKL18 | 051_RANKL18c11 | 7F11, SEQ ID NO: 577; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSS

>RANKL19 | 051_RANKL19c11 | 6C8, SEQ ID NO: 578; PRT; ->
EVQLVESGGGLVQAGDSLRLSCAASGRTVTMGWFRQAPGKEREFVASITGSGSVTNYADSVKGRFTISRDNA
KNTVFLQMNSLKPEDTAVYYCAAYLPSPYYSSYYDSTKYEYWGQGTQVTVSS

>RANKL20 | 051_RANKL20c11 | 2F4, SEQ ID NO: 579; PRT; ->
EVQLVESGGGLVQAGDSLRLSCAASGRTFTMGWFRQAPGTEREFVAAISGSGKITNYADSVKGRFTISRDHA
KNTVFLQMDSLKPEDTAVYYCAGYLRSPYYSSFYDSAKYEYWGQGTQVTVSS

>RANKL21 | 051_RANKL21c11 | 7C6, SEQ ID NO: 580; PRT; ->
EVQLVESGGGLVQAGGSLRLSCVASRRTFNSYAVGWFRQVPGEERDFVAAISTGSVTIYADSVKGRFTISRD
NAKNTVYLQMNSLKPEDTAVYYCAAGNREPYLRQYTASNPYDYWGQGTQVTVSS

>RANKL22 | 051_RANKL22c12 | 7D12, SEQ ID NO: 581; PRT; ->
EVQLVESGGGLMQTGGSLRLSCAASERTSRNYGMGWFRQAPGKEREFVAAITSAGGTTYYGDFVKGRFTISR
DSAKYTVYLQMNSLKPEDTAVYWCAAKLQIGGRWHNLNDYGYRGQGTQVTVSS

>RANKL23 | 051_RANKL23c11 | 9H5, SEQ ID NO: 582; PRT; ->
EVQLVESGGGLVQAGGSLRLSCAASGLTTVYTMAWFRQAPGKEREFVAAITRSGKTTYYADSVKGRFTISRD
NAKNTVNLQMNSLKPDDTAVYYCAAKALLGMTNPAGYEYWGQETQVTVSS

>RANKLPMP4B3, SEQ ID NO: 584; PRT; ->
evqlvesgggwmqaggslrlscaasgrtftftMAwfrqasgkerefvaAITGSGRSTYYTDSVKGrftisrdna
kntaylqmkslkpedtavyycagLRGLGLEYDSAKSYSYwgqgtqvtvss >RANKLPMP2E11, SEQ ID NO: 585; PRT; ->
EVXLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSS >RANKLPMP2A6, SEQ ID NO: 586; PRT; ->
evqlvesggglvqaggslrlscaasgltssRYTMSwfrqdpgkerefvaAVPLSGNTYYADPVRGrftisrd
nakntvdlqmnslkpedtavyycaaRASGSIFNRGSYAYwgqgtqvtvss >RANKLPMP1F2, SEQ ID NO: 587; PRT; ->
evqlvesggglvpaggslrlscaasgltdrRYTMSwfrqdpgkerefvaAVPLSGNTYYADPVRGrftisrd
nakntvdlqmnslkpedtavyycaaRASGSIFNRGSYAYwgqgtqvtvss >RANKLPMP2D4, SEQ ID NO: 588; PRT; ->
evqlvesggglvpaggslrlscaasgltdrRYTMSwfrqdpgkerefvaAVPLSGNTYYADPVGSrftisrd
nakntvdlqmnslkpedtavyycaaRASGSIFNRGSYAYwgqgtqvtvss >RANKLPMP7B2, SEQ ID NO: 589; PRT; ->
evqlvesggglvqaggslrlscaaaggtfrNYVMGwfrqapgkerefvtAISTGGSWTGYVDSVKDrftisr
dntkntvylqmaslkpedtavyycaaTMPATTYLPRSERQYDYwgqgtqvtvss TABLE B-1-continued Preferred Nanobodies against RANK-L (inhibitors of RANK/RANK-L interaction)

<Name, SEQ ID #; PRT (protein); ->
Sequence

>RANKLPMP7A11, SEQ ID NO: 590; PRT; ->
evqlvesgggglvqaggsltlscaaagftfrRYVMGwfrqapgkerefvaAISTGGTWTGYVDSVKDrftisr
dntkntvylqmaslkpedtavyncaaTTPTTSYLPRSERQYEYwgqgtqvtvss >RANKLPMP7F1, SEQ ID NO: 591; PRT; ->
evqlvesgggglvqaggslrlscaaagctfrNYVMGwfrqapgkerefvtAISTGGTWTSYVDSVKDrftisr
dntkntvnlqmaslkpedtavyycaaTTPTTSYLPRSERQYEYwgqgtqvtvss >RANKLPMP7H5, SEQ ID NO: 592; PRT; ->
evqlvesgggglvqaggslrlscaaaggtfrNYVMGwfrqapgkerefvaAISTGGSWTGYVDSVKDrftisr
dntkntvylqmvslkpedtavyycaaTTPATTYLPRSERQYDYwgqgtqvtvss >RANKLPMP7E7, SEQ ID NO: 593; PRT; ->
evqlvesgggglvqaggslrlscaaaggtfrNYVMGwfrqapgkerefvtAISAGGSWTGYVDSVKDrftisr
dntkntvylqmaslkpedtavyycaaTTPATTYLPRSERQYDYwgqgtqvtvss >RANKLPMP7E2, SEQ ID NO: 594; PRT; ->
evqlvesgggglvqaggslrlscaaagytfrAYVMGwfrqapgkerefvaGISTGGTWTGYVDSVKDrftisr
dntkntvylqmaslkpedtavyycaaTTPVTSYLPRSERQYEHwgqgtqvtvss >RANKLPMP3H10, SEQ ID NO: 595; PRT; ->
evqlvesgggglvqsgggslrlscaaagytfrARAYVMGwfrqapgkerefvaAISTGGTWTGYVDSVKDrfti
srdntkntmylqmaslkpedtavyycaaTTPSTSYLPRSERQYEYwgqgtqvtvss >RANKLPMP7F9, SEQ ID NO: 596; PRT; ->
evqlvesgggglvqaggslrlscvasrrtfsSYAMGwfrqvpgkerdfvaAISTGSITIYGDSVKGrftisrd
nakntvylqmnslkpedtavyycaaGKREPYLRQYTASNPYDYwgqgtqvtvss >RANKLPMP7E6, SEQ ID NO: 597; PRT; ->
evqlvesgggglvqaggslrlscvaskrtfaSYAMGwfrqvpgkerdfvaAITTGSITIYADSVKGrfaisrd
nakntvylqmnslkpedtavyycaaGNREPYLRQYTASNPYDYwgqgtqvtvss >RANKLPMP4F4, SEQ ID NO: 598; PRT; ->
evqlvesgggglvqvgdslrlsceasgrsrfSTYVMGwfrqapgkerefvaAVSWSSGNAYYIDSAKGrfats
rdtaknimylqmnslkpedtavytcaaGRGYGLLSEYTQAPRYDYwgqgtqvtvss >RANKLPMP7B11, SEQ ID NO: 599; PRT; ->
evqlvesgggglvqvgdslrlsceasgrsrfSTYVMGwfrqapgkerefvaAISWSSGNAYYlDSAKGrfats
rdtaknimylqmnslkpedtavyscaaGRGYGLLSEYlQAARYDYwgqgtqvtvss >RANKLPMP9H9, SEQ ID NO: 600; PRT; ->
evqlvesgggglvqaggslrlscaasgrtfsRSAMGwfrqapgkerefvgFITGSGGTTYYGESVKGrftisr
dnaqnpvylqmnslkpedtavyycgvYRRTYISSTYSESSEYDYwgqgtqvtvss >RANKLPMP9G3, SEQ ID NO: 601; PRT; ->
evqlvesgggglvqaggslrlscaasgrtfsRSAMGwfrqapgkerefvgFITGSGGTTYYGESVKGrftisr
dnaqnpvylqmnslkpedtavyycavYRRTYISSTYNESSEYDYwgqgtqvtvss >RANKLPMP9E3, SEQ ID NO: 602; PRT; ->
evqlvesgggglvqaggslrlscaasgrtfsRSAMGwfrqapgkerefvgFITGSGGTTYYGESVKGrftisr
dnaqnpvylqmnslkpedtavyycgvYRRTYISSTYSESSEYDYwgqgtqvtvss >RANKLPMP7H9, SEQ ID NO: 603; PRT; ->
evqlvesgggglvqaggslrlscaasgrtfsRSAMGwfrqapgkerefvgFITGSGGTTYYGESVKGrftisr
dnaqnpvylqmnslkpedtavyycgvYRRTYISITYSESSDYDYwgqgtqvtvss >RANKLPMP4C3, SEQ ID NO: 604; PRT; ->
evqlvesgggglvqaggslrlscaasgrtfsISAMGwfrqapgkerefvcFITGSGGTTYYGESVKGrftisr
dnaqnpvylqmnslkpedtavyycgvYRRTYISSTYSESSEYDYwgqgtqvtvss >RANKLPMP9G6, SEQ ID NO: 605; PRT; ->
evqlvesgggglvqaggslrlscaasgrtfsRSAMGwfrqapgkerefvgFITGSGGTTYYGESVKGrftisr
dnaqnpvylqmnslkpedtavyycgvYRRTYISSTYSESSEYDYwgqgtqvtvss TABLE B-1-continued Preferred Nanobodies against RANK-L (inhibitors of RANK/RANK-L interaction)

<Name, SEQ ID #; PRT (protein); ->
Sequence

>RANKLPMP7B12, SEQ ID NO: 606; PRT; ->
evqlvesggglvqaggslrlscaasgrtfsRSAMGwfrqapgkerefvgFITGSGGTTYYGESVKGrftisr
dnaqnpvylqmnslkpedtavyycgvYRRTYISSTYSESSEYDYwgqgtqvtvss >RANKLPMP7G3, SEQ ID NO: 607; PRT; ->
evqlvesggglvqaggslrlscaasgrtfsRSAMGwfrqapgkerefvgFITGSGGTTYYGESVKGrftisr
dnaqnpvylqmnslkpedtavyycavYRRTYISSTYNESSEYDYwgqgtqvtvss >RANKLPMP9C12, SEQ ID NO: 608; PRT; ->
evqlvesggglvqaggslrlscaasgrtfsRSAMGwfrqapgkerefvgFITGSGGTTYYGESVKGrftisr
dnaqnpvylqmnslkpedtavyycgvYRRTYISSTYSESSEYDYwgqgtqvtvss >RANKLPMP1D8, SEQ ID NO: 609; PRT; ->
evqlvesggglvqagdslrlscaasgriftMGwfrqapgkerefvaAISGSGSITNYADSVKGrftisrdya
kttvflqmnslkpedtavyycaaYVRTPYYSSYYDSTKYEYwgqgtqvtvss >RANKLPMP1A2, SEQ ID NO: 610; PRT; ->
evqlvesggglvqagdslrlscaasgrtftMGwfrqapgkerefvaFISGSGSVTNYTDSVKGrftisrdha
kntvflqmnslkpedtavyycaaYLRGPYYSSFYDSTKYEYwgqgtqvtvss >RANKLPMP1E5, SEQ ID NO: 611; PRT; ->
evqlvesggglvqagdslrlscaasgrtftMGwfrrapgterefvaSISGSGKITNYADSVKGrftisrdha
knavflqmdglkpedtavyycaaYLRSPYYSSYYDSAKYEYwgqgtqvtvss >RANKLPMP2B8, SEQ ID NO: 612; PRT; ->
evqlvesgggsvqagdslrlscaasgrtftMGwfrqapgterefvaAISGSGKITNYADSVKGrftisrdha
mntvflqmdslkpedtavyycaaYLRSPYYSSYYDSAKYEYwgqgtqvtvss >RANKLPMP2C5, SEQ ID NO: 613; PRT; ->
evqlvesggglvqagdslrlscaasgrtftMGwfrqapgterefvaAISGSGKITNYADSVKGrftisrdha
kntvflqmdslkpedtavyycaaYLRSPYYSSYYDSAKYEYwgqgtqvtvss >RANKLPMP2B4, SEQ ID NO: 614; PRT; ->
evqlvesggglvqagdslrlscaasgrtftMGwfrqapgterefvaAISGSGKITNYADSVKGrftisrdha
kntvflqmdslkpedtavyycaaYLRSPYYSSYYDSAKYEYwgqgtqvtvss >RANKLPMP2A5, SEQ ID NO: 615; PRT; ->
evqlvesggglvqagdslrlscaasgrtftMGwfrqapgterefvaAISGSGKITNYADSVKGrftisrdha
kntvflqmdslkpedtavyycaaYLRSPYYSSYYDSAKYEYwgqgtqvtvss >RANKLPMP2D7, SEQ ID NO: 616; PRT; ->
evqlvesggglvqagdslrlscaasgrtftMGwfrqapgterefvaAISGSGKITNYADSVKGrftisrdha
kntvflqmdslkpedtavyycaaYLRSPYYSSYYDSAKYEYwgqgtqvtvss >RANKLPMP2G4, SEQ ID NO: 617; PRT; ->
evqlvesggglvqagdslrlscaasgrtftMGwfrqapgterefvaAISGSGKITNYADSVKGrftisrdha
kntvflqmdslkpedtavyycaaYLRSPYYSSYYDSAKYEYwgqgtqvtvss >RANKLPMP7A8, SEQ ID NO: 618; PRT; ->
emqlvesggglvqaggslrlscvaskrtfaSYAMGwfrqvpgkerdfvaAISTHSITVYADSVKGrftisrd
nakntvylqmntlkpedtavyycaaGNREPYLRQYlASNPYDYwgqgtqvtvss >RANKLPMP7A5, SEQ ID NO: 619; PRT; ->
evqlvesggglvqtggslrlscvasrrtfsSYAVGwfrqvpgkerdfvaAISTGSVTIYADSVKGrftisrd
ntkntvylqmnslkpedtavyycaaGNREPYLRQYTASNPYDYwgqgtqvtvss >RANKLPMP7F8, SEQ ID NO: 620; PRT; ->
EVQLVESGGGLVQAGGSLRLSCAAAGGTFRNYVMGWFRQAPGKEREFVTAISTGGSWTGYVDSVKDRFTISR
DNTKNTVYLHMASLKPEDTAVYYCAATTPVTTYLPRSERQYDYWGQGTQVTVSS >RANKLPMP7F6, SEQ ID NO: 621; PRT; ->
EVQLVESGGGLVQAGDSLRLSCAAAGFTFRRYVMGWFRQAPGKEREFVAAISTGGTWTGYVDSVKDRFTISR
DNTKNTVYLQMASLKPEDTAVYNCAATTPTTSYLPRSERQYEYWGQGTQVTVSS

TABLE B-2

Preferred NANOBODIES against RANK-L (non-inhibitors of RANK/RANK-L interaction)

<Name, SEQ ID #; PRT (protein); ->
Sequence

>RANKL3D4 | 051_RANKL3D4c12 | 3D4, SEQ ID NO: 583; PRT; ->
EVQLVEAGGGLVQAGDSLRLSCAASGRTIRGTMAWFRQAPGKDREFVATVTSSGSTTFYADSVKGRFTISRD
NAENTVNLQMDSLKPEDTAVYYCAARIRGKVTPSNYDYAYWGQGTQVTVSS

TABLE B-3

Bivalent NANOBODIES against RANK-L

<Name, SEQ ID #; PRT (protein); ->
Sequence

>RANKL3-9GS-RANKL3, SEQ ID NO: 622; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGKLVQAG
GSLRLSCAVSGRTSSIYNMAWFRQGPGKGRESVGRIYWSDDNTYYADSVKGRFTISRDNATNTVYLQMNSLK
PEDTAVYYCAGKTTKWSLEYDYWGQGTQVTVSS

>RANKL3-9GS-RANKL6, SEQ ID NO: 623; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLMQTG
GSLRLSCAASGVTYSYYTASWFRQAPGKEREFVAAISPSGNTYYADSVKGRFTISRDNGKHTMYLQMNSLNP
EDTAVYFCAIRATDSIYYASSYRHWGQGTQVTVSS

>RANKL3-9GS-RANKL9, SEQ ID NO: 624; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQAG
GSLRLTCAASGRTFRSYAMGWFRQAPGKEREFVAAINYSGGSTNYADSVKGRFTISRDNAKNTLYLQMNSLE
PEDTAVYYCAAGSGYASLSYYSTERAYTYWGQGTQVTVSS

>RANKL3-9GS-RANKL13, SEQ ID NO: 625; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQAG
GSLRLSCAASGRTFRSYPMGWFRQAPGKEREFVASITGSGGSTYYADSVKGRFTISRDNAKNTVYLQMNSLR
PEDTAVYSCAAYIRPDTYLSRDYRKYDYWGQGTQVTVSS

>RANKL3-9GS-RANKL15, SEQ ID NO: 626; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQAG
GSLRLSCAAAGGTFRNYVMGWFRQAPGKEREFVTAISTGGSWTGYVDSVKDRFTISRDNTKNTVYLQMASLK
PEDTAVYYCAATTPATTYLPRSERQYDYWSQGTQVTVSS

>RANKL3-9GS-RANKL18, SEQ ID NO: 627; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQAG
GSLRLSCAASGRTFSRSAMGWFRQAPGKEREFVGFITGSGGTTYYGESVKGRFTISRDNAQNPVYLQMNSLK
PEDTAVYYCGVYRRTYISSTYSESSEYDYWGQGTQVTVSS

>RANKL6-9GS-RANKL3, SEQ ID NO: 628; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGKLVQ
AGGSLRLSCAVSGRTSSIYNMAWFRQGPGKGRESVGRIYWSDDNTYYADSVKGRFTISRDNATNTVYLQMNS
LKPEDTAVYYCAGKTTKWSLEYDYWGQGTQVTVSS

>RANKL6-9GS-RANKL6, SEQ ID NO: 629; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLMQ
TGGSLRLSCAASGVTYSYYTASWFRQAPGKEREFVAAISPSGNTYYADSVKGRFTISRDNGKHTMYLQMNSL
NPEDTAVYFCAIRATDSIYYASSYRHWGQGTQVTVSS

>RANKL6-9GS-RANKL9, SEQ ID NO: 630; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
AGGSLRLTCAASGRTFRSYAMGWFRQAPGKEREFVAAINYSGGSTNYADSVKGRFTISRDNAKNTLYLQMNS
LEPEDTAVYYCAAGSGYASLSYYSTERAYTYWGQGTQVTVSS

>RANKL6-9GS-RANKL13, SEQ ID NO: 631; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
AGGSLRLSCAASGRTFRSYPMGWFRQAPGKEREFVASITGSGGSTYYADSVKGRFTISRDNAKNTVYLQMNS
LRPEDTAVYSCAAYIRPDTYLSRDYRKYDYWGQGTQVTVSS

TABLE B-3-continued

Bivalent NANOBODIES against RANK-L

<Name, SEQ ID #; PRT (protein); ->
Sequence

>RANKL6-9GS-RANKL15, SEQ ID NO: 632; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
AGGSLRLSCAAAGGTFRNYVMGWFRQAPGKEREFVTAISTGGSWTGYVDSVKDRFTISRDNTKNTVYLQMAS
LKPEDTAVYYCAATTPATTYLPRSERQYDYWGQGTQVTVSS

>RANKL6-9GS-RANKL18, SEQ ID NO: 633; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
AGGSLRLSCAASGRTFSRSAMGWFRQAPGKEREFVGFITGSGGTTYYGESVKGRFTISRDNAQNPVYLQMNS
LKPEDTAVYYCGVYRRTYISSTYSESSEYDYWGQGTQVTVSS

>RANKL9-9GS-RANKL3, SEQ ID NO: 634; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGS
EVQLVESGGKLVQAGGSLRLSCAVSGRTSSIYNMAWFRQGPGKSRESVGRIYWSDDNTYYADSVKGRFTISR
DNATNTVYLQMNSLKPEDTAVYYCAGKTTKWSLEYDYWGQGTQVTVSS

>RANKL9-9GS-RANKL6, SEQ ID NO: 635; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLMQTGGSLRLSCAASGVTYSYYTASWFRQAPGKEREFVAAISPSGNTYYADSVKGRFTISRDNGKHTMYL
QMNSLNPEDTAVYFCAIRATDSIYYASSYRHWGQGTQVTVSS

>RANKL91biv | RANKL9-9GS-RANKL9, SEQ ID NO: 636; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQAGGSLRLTCAASGRTFRSYAMGWFRQAPGKEREFVAAINYSGGSTNYADSVKGRFTISRDNAKNTLY
LQMNSLEPEDTAVYYCAAGSGYASLSYYSTERAYTYWGQGTQVTVSS >RANKL9-9GS-RANKL13, SEQ ID NO: 637; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQAGGSLRLSCAASGRTFRSYPMGWFRQAPGKEREFVASITGSGGSTYYADSVKGRFTISRDNAKNTVY
LQMNSLRPEDTAVYSCAAYIRPDTYLSRDYRKYDYWGQGTQVTVSS >RANKL9-9GS-RANKL15, SEQ ID NO: 638; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQAGGSLRLSCAAAGGTFRNYVMGWFRQAPGKEREFVTAISTGGSWTGYVDSVKDRFTISRDNTKNTVY
LQMASLKPEDTAVYYCAATTPATTYLPRSERQYDYWGQGTQVTVSS >RANKL9-9GS-RANKL18, SEQ ID NO: 639; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQAGGSLRLSCAASGRTFSRSAMGWFRQAPGKEREFVSFITGSGGTTYYGESVKGRFTISRDNAQNPVY
LQMNSLKPEDTAVYYCGVYRRTYISSTYSESSEYDYWGQGTQVTVSS >RANKL13-9GS-RANKL3, SEQ ID NO: 640; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
KLVQAGGSLRLSCAVSGRTSSIYNMAWFRQGPGKGRESVGRIYWSDDNTYYADSVKGRFTISRDNATNTVYL
QMNSLKPEDTAVYYCAGKTTKWSLEYDYWGQGTQVTVSS >RANKL13-9GS-RANKL6, SEQ ID NO: 641; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLMQTGGSLRLSCAASGVTYSYYTASWFRQAPGKEREFVAAISPSGNTYYADSVKGRFTISRDNGKHTMYLQ
MNSLNPEDTAVYFCAIRATDSIYYASSYRHWGQGTQVTVSS >RANKL13-9GS-RANKL9, SEQ ID NO: 642; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQAGGSLRLTCAASGRTFRSYAMGWFRQAPGKEREFVAAINYSGGSTNYADSVKGRFTISRDNAKNTLYL
QMNSLEPEDTAVYYCAAGSGYASLSYYSTERAYTYWGQGTQVTVSS >RANKL131 | RANKL13-9GS-RANKL13, SEQ ID NO: 643; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQAGGSLRLSCAASGRTFRSYPMGWFRQAPGKEREFVASITGSGGSTYYADSVKGRFTISRDNAKNTVYL
QMNSLRPEDTAVYSCAAYIRPDTYLSRDYRKYDYWGQGTQVTVSS >RANKL13-9GS-RANKL15, SEQ ID NO: 644; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG TABLE B-3-continued Bivalent NANOBODIES against RANK-L <Name, SEQ ID #; PRT (protein); ->
Sequence GLVQAGGSLRLSCAAAGGTFRNYVMGWFRQAPGKEREFVTAISTGGSWTGYVDSVKDRFTISRDNTKNTVYL
QMASLKPEDTAVYYCAATTPATTYLPRSERQYDYWGQGTQVTVSS >RANKL13-9GS-RANKL18, SEQ ID NO: 645; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQAGGSLRLSCAASGRTFSRSAMGWFRQAPGKEREFVGFITGSGGTTYYGESVKGRFTISRDNAQNPVYL
QMNSLKPEDTAVYYCGVYRRTYISSTYSESSEYDYWGQGTQVTVSS >RANKL15-9GS-RANKL3, SEQ ID NO: 646; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
KLVQAGGSLRLSCAVSGRTSSIYNMAWFRQPGPGKGRESVGRIYWSDDNTYYADSVKGRFTISRDNATNTVYL
QMNSLKPEDTAVYYCAGKTTKWSLEYDYWGQGTQVTVSS >RANKL15-9GS-RANKL6, SEQ ID NO: 647; PRT; ->
EVQLVESGGGLVQAGGSLRLSCAAAGGTFRNYVMGWFRQAPGKEREFVTAISTGGSWTSYVDSVKDRFTISR
DNTKNTVYLQMASLKPEDTAVYYCAATTPATTYLPRSERQYDYWGQGTQVTVSSGGGGSGGGSEVQLVESGG
SLMQTGGSLRLSCAASGVTYSYYTASWFRQAPGKEREFVAAISPSGNTYYADSVKGRFTISRDNGKHTMYLQ
MNSLNPEDTAVYFCAIRATDSIYYASSYRHWGQGTQVTVSS >RANKL15-9GS-RANKL9, SEQ ID NO: 648; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQAGGSLRLTCAASGRTFRSYAMGWFRQAPGKEREFVAAINYSGGSTNYADSVKGRFTISRDNAKNTLYL
QMNSLEPEDTAVYYCAAGSGYASLSYYSTERAYTYWGQGTQVTVSS >RANKL15-9GS-RANKL13, SEQ ID NO: 649; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQAGGSLRLSCAASGRTFRSYPMGWFRQAPGKEREFVASITGSGGSTYYADSVKGRFTISRDNAKNTVYL
QMNSLRPEDTAVYSCAAYIRPDTYLSRDYRKYDYWGQGTQVTVSS >RANKL15-9GS-RANKL15, SEQ ID NO: 650; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQAGGSLRLSCAAAGGTFRNYVMGWFRQAPGKEREFVTAISTGGSWTGYVDSVKDRFTISRDNTKNTVYL
QMASLKPEDTAVYYCAATTPATTYLPRSERQYDYWGQGTQVTVSS >RANKL15-9GS-RANKL18, SEQ ID NO: 651; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQAGGSLRLSCAASGRTFSRSAMGWFRQAPGKEREFVGFITGSGGTTYYGESVKGRFTISRDNAQNPVYL
QMNSLKPEDTAVYYCGVYRRTYISSTYSESSEYDYWGQGTQVTVSS >RANKL18-9GS-RANKL3, SEQ ID NO: 652; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGSEVQLVESG
GKLVQAGGSLRLSCAVSGRTSSIYNMAWFRQPGPGKGRESVGRIYWSDDNTYYADSVKGRFTISRDNATNTV
YLQMNSLKPEDTAVYYCAGKTTKWSLEYDYWGQGTQVTVSS >RANKL18-9GS-RANKL6, SEQ ID NO: 653; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGSEVQLVESG
GGLMQTGGSLRLSCAASGVTYSYYTASWFRQAPGKEREFVAAISPSGNTYYADSVKGRFTISRDNGKHTMYL
QMNSLNPEDTAVYFCAIRATDSIYYASSYRHWGQGTQVTVSS >RANKL18-9GS-RANKL9, SEQ ID NO: 654; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGSEVQLVESG
GGLVQAGGSLRLTCAASGRTFRSYAMGWFRQAPGKEREFVAAINYSGGSTNYADSVKGRFTISRDNAKNTLY
LQMNSLEPEDTAVYYCAAGSGYASLSYYSTERAYTYWGQGTQVTVSS >RANKL18-9GS-RANKL13, SEQ ID NO: 655; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGSEVQLVESG
GGLVQAGGSLRLSCAASGRTFRSYPMGWFRQAPGKEREFVASITGSGGSTYYADSVKGRFTISRDNAKNTVY
LQMNSLRPEDTAVYSCAAYIRPDTYLSRDYRKYDYWGQGTQVTVSS >RANKL18-9GS-RANKL15, SEQ ID NO: 656; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGSEVQLVESG
GGLVQAGGSLRLSCAAAGGTFRNYVMGWFRQAPGKEREFVTAISTGGSWTGYVDSVKDRFTISRDNTKNTVY
LQMASLKPEDTAVYYCAATTPATTYLPRSERQYDYWGQGTQVTVSS TABLE B-3-continued Bivalent NANOBODIES against RANK-L <Name, SEQ ID #; PRT (protein); ->
Sequence >RANKL181 | RANKL18-9GS-RANKL18, SEQ ID NO: 657; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGGSEVQLVESG
GGLVQAGGSLRLSCAASGRTFSRSAMGWFRQAPGKEREFVGFITGSGGTTYYGESVKGRFTISRDNAQNPVY
LQMNSLKPEDTAVYYCGVYRRTYISSTYSESSEYDYWGQGTQVTVSS >RANKL3-20GS-RANKL3, SEQ ID NO: 658; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGGSGGGGSGGGGSEVQL
VESGGKLVQAGGSLRLSCAVSGRTSSIYNMAWFRQGPGKGRESVGRIYWSDDNTYYADSVKGRFTISRDNAT
NTVYLQMNSLKPEDTAVYYCAGKTTKWSLEYDYWGQGTQVTVSS >RANKL3-20GS-RANKL6, SEQ ID NO: 659; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGGSGGGGSGGGGSEVQL
VESGGGLMQTGGSLRLSCAASGVTYSYYTASWFRQAPGKEREFVAAISPSGNTYYADSVKGRFTISRDNGKH
TMYLQMNSLNPEDTAVYFCAIRATDSIYYASSYRHWGQGTQVTVSS >RANKL3-20GS-RANKL9, SEQ ID NO: 660; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGGSGGGGSGGGGS
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSS >RANKL3-20GS-RANKL13, SEQ ID NO: 661; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGGSGGGGSGGGGSEVQL
VESGGGLVQAGGSLRLSCAASGRTFRSYPMGWFRQAPGKEREFVASITGSGGSTYYADSVKGRFTISRDNAK
NTVYLQMNSLRPEDTAVYSCAAYIRPDTYLSRDYRKYDYWGQGTQVTVSS >RANKL3-20GS-ANKL15, SEQ ID NO: 662; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGGSGGGGSGGGGSEVQL
VESGGGLVQAGGSLRLSCAAAGGTFRNYVMGWFRQAPGKEREFVTAISTGGSWTGYVDSVKDRFTISRDNTK
NTVYLQMASLKPEDTAVYYCAATTPATTYLPRSERQYDYWGQGTQVTVSS >RANKL3-20GS-RANKL18, SEQ ID NO: 663; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGGSGGGGSGGGGSEVQL
VESGGGLVQAGGSLRLSCAASGRTFSRSAMGWFRQAPGKEREFVGFITGSGGTTYYGESVKGRFTISRDNAQ
NPVYLQMNSLKPEDTAVYYCGVYRRTYISSTYSESSEYDYWGQGTQVTVSS >RANKL6-20GS-RANKL3, SEQ ID NO: 664; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGGSGGGGSGGGGSEV
QLVESGGKLVQAGGSLRLSCAVSGRTSSIYNMAWFRQGPGKGRESVGRIYWSDDNTYYADSVKGRFTISRDN
ATNTVYLQMNSLKPEDTAVYYCAGKTTKWSLEYDYWGQGTQVTVSS >RANKL6-20GS-RANKL6, SEQ ID NO: 665; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGGSGGGGSGGGGSEV
QLVESGGGLMQTGGSLRLSCAASGVTYSYYTASWFRQAPGKEREFVAAISPSGNTYYADSVKGRFTISRDNG
KHTMYLQMNSLNPEDTAVYFCAIRATDSIYYASSYRHWGQGTQVTVSS >RANKL6-20GS-RANKL9, SEQ ID NO: 666; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGGSGGGGSGGGGSEV
QLVESGGGLVQAGGSLRLTCAASGRTFRSYAMGWFRQAPGKEREFVAAINYSGGSTNYADSVKGRFTISRDN
AKNTLYLQMNSLEPEDTAVYYCAAGSGYASLSYYSTERAYTYWGQGTQVTVSS >RANKL6-20GS-RANKL13, SEQ ID NO: 667; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGGSGGGGSGGGGSEV
QLVESGGGLVQAGGSLRLSCAASGRTFRSYPMGWFRQAPGKEREFVASITGSGGSTYYADSVKGRFTISRDN
AKNTVYLQMNSLRPEDTAVYSCAAYIRPDTYLSRDYRKYDYWGQGTQVTVSS >RANKL6-20GS-RANKL15, SEQ ID NO: 668; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGGSGGGGSGGGGSEV
QLVESGGGLVQAGGSLRLSCAAAGGTFRNYVMGWFRQAPGKEREFVTAISTGGSWTGYVDSVKDRFTISRDN
TKNTVYLQMASLKPEDTAVYYCAATTPATTYLPRSERQYDYWGQGTQVTVSS >RANKL6-20GS-RANKL18, SEQ ID NO: 669; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGGSGGGGSGGGGS TABLE B-3-continued Bivalent NANOBODIES against RANK-L <Name, SEQ ID #; PRT (protein); ->
Sequence EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSS >RANKL9-20GS-RANKL3, SEQ ID NO: 670; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGGSGGGGSGG
GGSEVQLVESGGKLVQAGGSLRLSCAVSGRTSSIYNMAWFRQGPGKGRESVGRIYWSDDNTYYADSVKGRFT
ISRDNATNTVYLQMNSLKPEDTAVYYCAGKTTKWSLEYDYWGQGTQVTVSS >RANKL9-20GS-RANKL6, SEQ ID NO: 671; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGGSGGGGSGG
GGSEVQLVESGGGLMQTGGSLRLSCAASGVTYSYYTASWFRQAPGKEREFVAAISPSGNTYYADSVKGRFTI
SRDNGKHTMYLQMNSLNPEDTAVYFCAIRATDSIYYASSYRHWGQGTQVTVSS >RANKL9-2biv | RANKL9-20GS-RANKL9, SEQ ID NO: 672; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGGSGGGGSGG
GGSEVQLVESGGGLVQAGGSLRLTCAASGRTFRSYAMGWFRQAPGKEREFVAAINYSGGSTNYADSVKGRFT
ISRDNAKNTLYLQMNSLEPEDTAVYYCAAGSGYASLSYYSTERAYTYWGQGTQVTVSS >RANKL9-20GS-RANKL13, SEQ ID NO: 673; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGGSGGGGSGG
GGSEVQLVESGGGLVQAGGSLRLSCAASGRTFRSYPMGWFRQAPGKEREFVASITGSGGSTYYADSVKGRFT
ISRDNAKNTVYLQMNSLRPEDTAVYSCAAYIRPDTYLSRDYRKYDYWGQGTQVTVSS >RANKL9-20GS-RANKL15, SEQ ID NO: 674; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGGSGGGGSGG
GGSEVQLVESGGGLVQAGGSLRLSCAAAGGTFRNYVMGWFRQAPGKEREFVTAISTGGSWTGYVDSVKDRFT
ISRDNTKNTVYLQMASLKPEDTAVYYCAATTPATTYLPRSERQYDYWGQGTQVTVSS >RANKL9-20GS-RANKL18, SEQ ID NO: 675; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGGSGGGGSGG
GGSEVQLVESGGGLVQAGGSLRLSCAASGRTFSRSAMGWFRQAPGKEREFVGFITGSGGTTYYGESVKGRFT
ISRDNAQNPVYLQMNSLKPEDTAVYYCGVYRRTYISSTYSESSEYDYWGQGTQVTVSS >RANKL13-20GS-RANKL3, SEQ ID NO: 676; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGGSGGGGSGGG
GSEVQLVESGGKLVQAGGSLRLSCAVSGRTSSIYNMAWFRQGPGKGRESVGRIYWSDDNTYYADSVKGRFTI
SRDNATNTVYLQMNSLKPEDTAVYYCAGKTTKWSLEYDYWGQGTQVTVSS >RANKL13-20GS-RANKL6, SEQ ID NO: 677; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGGSGGGGSGGG
GSEVQLVESGGGLMQTGGSLRLSCAASGVTYSYYTASWFRQAPGKEREFVAAISPSGNTYYADSVKGRFTIS
RDNGKHTMYLQMNSLNPEDTAVYFCAIRATDSIYYASSYRHWGQGTQVTVSS >RANKL13-20GS-RANKL9, SEQ ID NO: 678; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGGSGGGGSGGG
GSEVQLVESGGGLVQAGGSLRLTCAASGRTFRSYAMGWFRQAPGKEREFVAAINYSGGSTNYADSVKGRFTI
SRDNAKNTLYLQMNSLEPEDTAVYYCAAGSGYASLSYYSTERAYTYWGQGTQVTVSS >RANKL13-20GS-RANKL13, SEQ ID NO: 679; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGGSGGGGSGGG
GSEVQLVESGGGLVQAGGSLRLSCAASGRTFRSYPMGWFRQAPGKEREFVASITGSGGSTYYADSVKGRFTI
SRDNAKNTVYLQMNSLRPEDTAVYSCAAYIRPDTYLSRDYRKYDYWGQGTQVTVSS >RANKL13-20GS-RANKL15, SEQ ID NO: 680; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGGSGGGGSGGG
GSEVQLVESGGGLVQAGGSLRLSCAAAGGTFRNYVMGWFRQAPGKEREFVTAISTGGSWTGYVDSVKDRFTI
SRDNTKNTVYLQMASLKPEDTAVYYCAATTPATTYLPRSERQYDYWGQGTQVTVSS >RANKL13-20GS-RANKL18, SEQ ID NO: 681; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGGSGGGGSGGG
GSEVQLVESGGGLVQAGGSLRLSCAASGRTFSRSAMGWFRQAPGKEREFVGFITGSGGTTYYGESVKGRFTI
SRDNAQNPVYLQMNSLKPEDTAVYYCGVYRRTYISSTYSESSEYDYWGQGTQVTVSS TABLE B-3-continued Bivalent NANOBODIES against RANK-L <Name, SEQ ID #; PRT (protein); ->
Sequence >RANKL15-20GS-RANKL3, SEQ ID NO: 682; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGGSGGGGSGGG
GSEVQLVESGGKLVQAGGSLRLSCAVSGRTSSIYNMAWFRQGPGKGRESVGRIYWSDDNTYYADSVKGRFTI
SRDNATNTVYLQMNSLKPEDTAVYYCAGKTTKWSLEYDYWGQGTQVTVSS >RANKL15-20GS-RANKL6, SEQ ID NO: 683; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGGSGGGGSGGG
GSEVQLVESGGGLMQTGGSLRLSCAASGVTYSYYTASWFRQAPGKEREFVAAISPSGNTYYADSVKGRFTIS
RDNGKHTMYLQMNSLNPEDTAVYFCAIRATDSIYYASSYRHWGQGTQVTVSS >RANKL15-20GS-RANKL9, SEQ ID NO: 684; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGGSGGGGSGGG
GSEVQLVESGGGLVQAGGSLRLTCAASGRTFRSYAMGWFRQAPGKEREFVAAINYSGGSTNYADSVKGRFTI
SRDNAKNTLYLQMNSLEPEDTAVYYCAAGSGYASLSYYSTERAYTYWGQGTQVTVSS >RANKL15-20GS-RANKL13, SEQ ID NO: 685; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGGSGGGGSGGG
GSEVQLVESGGGLVQAGGSLRLSCAASGRTFRSYPMGWFRQAPGKEREFVASITGSGGSTYYADSVKGRFTI
SRDNAKNTVYLQMNSLRPEDTAVYSCAAYIRPDTYLSRDYRKYDYWGQGTQVTVSS >RANKL15-20GS-RANKL15, SEQ ID NO: 686; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGGSGGGGSGGG
GSEVQLVESGGGLVQAGGSLRLSCAAAGGTFRNYVMGWFRQAPGKEREFVTAISTGGSWTGYVDSVKDRFTI
SRDNTKNTVYLQMASLKPEDTAVYYCAATTPATTYLPRSERQYDYWGQGTQVTVSS >RANKL15-20GS-RANKL18, SEQ ID NO: 687; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGGSGGGGSGGG
GSEVQLVESGGGLVQAGGSLRLSCAASGRTFSRSAMGWFRQAPGKEREFVGFITGSGGTTYYGESVKGRFTI
SRDNAQNPVYLQMNSLKPEDTAVYYCGVYRRTYISSTYSESSEYDYWGQGTQVTVSS >RANKL18-20GS-RANKL3, SEQ ID NO: 688; PRT; ->
EVQLVESSSSLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGGSGGGGSGG
GGSEVQLVESGGKLVQAGGSLRLSCAVSGRTSSIYNMAWFRQGPGKGRESVGRIYWSDDNTYYADSVKGRFT
ISRDNATNTVYLQMNSLKPEDTAVYYCAGKTTKWSLEYDYWGQGTQVTVSS >RANKL18-20GS-RANKL6, SEQ ID NO: 689; PRT; ->
EVQLVESGGGLVQAGGSLRLSCAASGRTFSRSAMGWFRQAPGKEREFVGFITGSGGTTYYGESVKHRFTISR
DNAQNPVYLQMNSLKPEDTAVYYCGVYRRTYISSTYSESSEYDYWGQGTQVTVSSGGGGSGGGGSGGGGSGG
GGSEVQLVESGGGLMQTGGSLRLSCAASGVTYSYYTASWFRQAPGKEREFVAAISPSGNTYYADSVKGRFTI
SRDNGKHTMYLQMNSLNPEDTAVYFCAIRATDSIYYASSYRHWGQGTQVTVSS >RANKL18-20GS-RANKL9, SEQ ID NO: 690; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGGSGGGGSGG
GGSEVQLVESGGGLVQAGGSLRLTCAASGRTFRSYAMGWFRQAPGKEREFVAAINYSGGSTNYADSVKGRFT
ISRDNAKNTLYLQMNSLEPEDTAVYYCAAGSGYASLSYYSTERAYTYWGQGTQVTVSS >RANKL18-20GS-RANKL13, SEQ ID NO: 691; PRT; ->
EVQLVESGGGLVQAGGSLRLSCAASGRTFSRSAMGWFRQAPGKEREFVSFITGSGGTTYYGESVKGRFTISR
DNAQNPVYLQMNSLKPEDTAVYYCGVYRRTYISSTYSESSEYDYWGQGTQVTVSSGGGGSGGGGSGGGGSGG
GGSEVQLVESGGGLVQAGGSLRLSCAASGRTFRSYPMGWFRQAPGKEREFVASITGSGGSTYYADSVKGRFT
ISRDNAKNTVYLQMNSLRPEDTAVYSCAAYIRPDTYLSRDYRKYDYWGQGTQVTVSS >RANKL18-20GS-RANKL15, SEQ ID NO: 692; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGGSGGGGSGG
GGSEVQLVESGGGLVQAGGSLRLSCAAAGGTFRNYVMGWFRQAPGKEREFVTAISTGGSWTGYVDSVKDRFT
ISRDNTKNTVYLQMASLKPEDTAVYYCAATTPATTYLPRSERQYDYWGQGTQVTVSS >RANKL182biv | RANKL18-20GS-RANKL18, SEQ ID NO: 693; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGGSGGGGSGG
GGSEVQLVESGGGLVQAGGSLRLSCAASGRTFSRSAMGWFRQAPGKEREFVGFITGSGGTTYYGESVKGRFT
ISRDNAQNPVYLQMNSLKPEDTAVYYCGVYRRTYISSTYSESSEYDYWGQGTQVTVSS RANKL133 | RANKL13-30GS-RANKL13, SEQ ID NO: 766; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGGSGGGGSGGG

TABLE B-3-continued
Bivalent NANOBODIES against RANK-L

<Name, SEQ ID #; PRT (protein); ->
Sequence

GSGGGGSGGGGSEVQLVESGGGLVQAGGSLRLSCAASGRTFRSYPMGWFRQAPGKEREFVASITGSGGSTYY
ADSVKGRFTISRDNAKNTVYLQMNSLRPEDTAVYSCAAYIRPDTYLSRDYRKYDYWGQGTQVTVS

RANKL183biv | RANKL18-30GS-RANKL18, SEQ ID NO: 767; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTYISSTYSESSEYDYWGQGTQVTVSSGGGGSGGGGSGGGGSGG
GGSGGGGSGGGGSEVQLVESGGGLVQAGGSLRLSCAASGRTFSRSAMGWFRQAPGKEREFVGFITGSGGTTY
YGESVKGRFTISRDNAQNPVYLQMNSLKPEDTAVYYCGVYRRTYISSTYSESSEYDYWGQGTQVTVSS RANKL93biv | RANKL9-30GS-RANKL9, SEQ ID NO: 770; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGGSGGGGSGG
GGSGGGGSGGGGSEVQLVESGGGLVQAGGSLRLTCAASGRTFRSYAMGWFRQAPGKEREFVAAINYSGGSTN
YADSVKGRFTISRDNAKNTLYLQMNSLEPEDTAVYYCAAGSGYASLSYYSTERAYTYWGQGTQVTVSS RANKL94biv | RANKL9-15GS-RANKL9, SEQ ID NO: 771; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGGSGGGGSEV
QLVESGGGLVQAGGSLRLTCAASGRTFRSYAMGWFRQAPGKEREFVAAINYSGGSTNYADSVKGRFTISRDN
AKNTLYLQMNSLEPEDTAVYYCAAGSGYASLSYYSTERAYTYWGQGTQVTVSS

TABLE B-4
Trivalent bispecific NANOBODIES against RANK-L

<Name, SEQ ID #; PRT (protein); ->
Sequence

>RANKL30 | RANKL3-ALB1-RANKL3, SEQ ID NO: 694; PRT; ->
EVQLVESSSKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSSGGGGSGGGGSEVQLVESGGKLVQAGGSLRLSCAVSGRTSSIYNMA
WFRQGPGKGRESVGRIYWSDDNTYYADSVKGRFTISRDNATNTVYLQMNSLKPEDTAVYYCAGKTTKWSLEY
DYWGQGTQVTVSS

>RANKL3-ALB1-RANKL6, SEQ ID NO: 695; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSSGGGGSGGGGSEVQLVESGGGLMQTGGSLRLSCAASGVTYSYYTAS
WFRQAPGKEREFVAAISPSGNTYYADSVKGRFTISRDNGKHTMYLQMNSLNPEDTAVYFCAIRATDSIYYAS
SYRHWGQGTQVTVSS

>RANKL3-ALB1-RANKL9, SEQ ID NO: 696; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSSGGGGSGGGGSEVQLVESGGGLVQAGGSLRLTCAASGRTFRSYAMG
WFRQAPGKEREFVAAINYSGGSTNYADSVKGRFTISRDNAKNTLYLQMNSLEPEDTAVYYCAAGSGYASLSY
YSTERAYTYWGQGTQVTVSS

>RANKL3-ALB1-RANKL13, SEQ ID NO: 697; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSSGGGGSGGGGSEVQLVESGGGLVQAGGSLRLSCAASGRTFRSYPMG
WFRQAPGKEREFVASITGSGGSTYYADSVKGRFTISRDNAKNTVYLQMNSLRPEDTAVYSCAAYIRPDTYLS
RDYRKYDYWGQGTQVTVSS

>RANKL3-ALB1-RANKL15, SEQ ID NO: 698; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK
PEDTAVYYCTIGGSLSRSSQGTQVTVSSGGGGSGGGGSEVQLVESGGGLVQAGGSLRLSCAAAGGTFRNYVMG
WFRQAPGKEREFVTAISTGGSWTGYVDSVKDRFTISRDNTKNTVYLQMASLKPEDTAVYYCAATTPATTYLP
RSERQYDYWGQGTQVTVSS

>RANKL3-ALB1-RANKL18, SEQ ID NO: 699; PRT; ->
EVQLVESGGKLVQAGGSLRLSCAVSGRTSSIYNMAWFRQGPGKGRESVGRIYWSDDNTYYADSVKGRFTISR
DNATNTVYLQMNSLKPEDTAVYYCAGKTTKWSLEYDYWGQGTQVTVSSGGGGSGGGSEVQLVESGGGLVQPG
NSLRLSCAASGFTFRSFGMSWVRQAPGKEPEWVSSISGSGSDTLYADSVKGRFTISRDNAKTTLYLQMNSLK

TABLE B-4-continued

Trivalent bispecific NANOBODIES against RANK-L

<Name, SEQ ID #; PRT (protein); ->
Sequence

PEDTAVYYCTIGGSLSRSSQGTQVTVSSGGGGSGGGSEVQLVESGGGLVQAGGSLRLSCAASGRTFSRSAMG
WFRQAPGKEREFVGFITGSGGTTYYGESVKGRFTISRDNAQNPVYLQMNSLKPEDTAVYYCGVYRRTHISST
YSESSEYDYWGQGTQVTVSS

>RANKL6-ALB1-RANKL3, SEQ ID NO: 700; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
PGNSLRLSCAASGFTFRSFGMSWVRQAPGKEPEWVSSISGSGSDTLYADSVKGRFTISRDNAKTTLYLQMNS
LKPEDTAVYYCTIGGSLSRSSQGTQVTVSSGGGGSGGGSEVQLVESGGKLVQAGGSLRLSCAVSGRTSSIYN
MAWFRQGPGKGRESVGRIYWSDDNTYYADSVKGRFTISRDNATNTVYLQMNSLKPEDTAVYYCAGKTTKWSL
EYDYWGQGTQVTVSS

>RANKL60 | RANKL6-ALB1-RANKL6, SEQ ID NO: 701; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
PGNSLRLSCAASGFTFRSFGMSWVRQAPGKEPEWVSSISGSGSDTLYADSVKGRFTISRDNAKTTLYLQMNS
LKPEDTAVYYCTIGGSLSRSSQGTQVTVSSGGGGSGGGSEVQLVESGGGLMQTGGSLRLSCAASGVTYSYYT
ASWFRQAPGKEREFVAAISPSGNTYYADSVKGRFTISRDNGKHTMYLQMNSLNPEDTAVYFCAIRATDSIYY
ASSYRHWGQGTQVTVSS

>RANKL6-ALB1-RANKL9, SEQ ID NO: 702; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
PGNSLRLSCAASGFTFRSFGMSWVRQAPGKEPEWVSSISGSGSDTLYADSVKGRFTISRDNAKTTLYLQMNS
LKPEDTAVYYCTIGGSLSRSSQGTQVTVSSGGGGSGGGSEVQLVESGGGLVQAGGSLRLTCAASGRTFRSYA
MGWFRQAPGKEREFVAAINYSGGSTNYADSVKGRFTISRDNAKNTLYLQMNSLEPEDTAVYYCAAGSGYASL
SYYSTERAYTYWGQGTQVTVSS

>RANKL6-ALB1-RANKL13, SEQ ID NO: 703; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
PGNSLRLSCAASGFTFRSFGMSWVRQAPGKEPEWVSSISGSGSDTLYADSVKGRFTISRDNAKTTLYLQMNS
LKPEDTAVYYCTIGGSLSRSSQGTQVTVSSGGGGSGGGSEVQLVESGGGLVQAGGSLRLSCAASGRTFRSYP
MGWFRQAPGKEREFVASITGSGSTYYADSVKGRFTISRDNAKNTVYLQMNSLRPEDTAVYSCAAYIRPDTY
LSRDYRKYDYWGQGTQVTVSS

>RANKL6-ALB1-RANKL15, SEQ ID NO: 704; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
PGNSLRLSCAASGFTFRSFGMSWVRQAPGKEPEWVSSISGSGSDTLYADSVKGRFTISRDNAKTTLYLQMNS
LKPEDTAVYYCTIGGSLSRSSQGTQVTVSSGGGGSGGGSEVQLVESGGGLVQAGGSLRLSCAAAGGTFRNYV
MGWFRQAPGKEREFVTAISTGGSWTGYVDSVKDRFTISRDNTKNTVYLQMASLKPEDTAVYYCAATTPATTY
LPRSERQYDYWGQGTQVTVSS

>RANKL6-ALB1-RANKL18, SEQ ID NO: 705; PRT; ->
EVQLVESGGGLMQTGGSLRLSCAASGVTYSYYTASWFRQAPGKEREFVAAISPSGNTYYADSVKGRFTISRD
NGKHTMYLQMNSLNPEDTAVYFCAIRATDSIYYASSYRHWGQGTQVTVSSGGGGSGGGSEVQLVESGGGLVQ
PGNSLRLSCAASGFTFRSFGMSWVRQAPGKEPEWVSSISGSGSDTLYADSVKGRFTISRDNAKTTLYLQMNS
LKPEDTAVYYCTIGGSLSRSSQGTQVTVSSGGGGSGGGSEVQLVESGGGLVQAGGSLRLSCAASGRTFSRSA
MGWFRQAPGKEREFVGFITGSGGTTYYGESVKGRFTISRDNAQNPVYLQMNSLKPEDTAVYYCGVYRRTHIS
STYSESSEYDYWGQGTQVTVSS

>RANKL9-ALB1-RANKL3, SEQ ID NO: 706; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGKLVQAGGSLRLSCAVSGRT
SSIYNMAWFRQGPGKGRESVGRIYWSDDNTYYADSVKGRFTISRDNATNTVYLQMNSLKPEDTAVYYCAGKT
TKWSLEYDYWGQGTQVTVSS

>RANKL9-ALB1-RANKL6, SEQ ID NO: 707; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLMQTGGSLRLSCAASGVT
YSYYTASWFRQAPGKEREFVAAISPSGNTYYADSVKGRFTISRDNGKHTMYLQMNSLNPEDTAVYFCAIRAT
DSIYYASSYRHWGQGTQVTVSS

>RANKL90 | RANKL9-ALB1-RANKL9, SEQ ID NO: 708; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLVQAGGSLRLTCAASGRT
FRSYAMGWFRQAPGKEREFVAAINYSGGSTNYADSVKGRFTISRDNAKNTLYLQMNSLEPEDTAVYYCAAGS
GYASLSYYSTERAYTYWGQGTQVTVSS

TABLE B-4-continued

Trivalent bispecific NANOBODIES against RANK-L

<Name, SEQ ID #; PRT (protein); ->
Sequence

>RANKL9-ALB1-RANKL13, SEQ ID NO: 709; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLVQAGGSLRLSCAASGRT
FRSYPMGWFRQAPGKEREFVASITGSGGSTYYADSVKGRFTISRDNAKNTVYLQMNSLRPEDTAVYSCAAYI
RPDTYLSRDYRKYDYWGQGTQVTVSS

>RANKL9-ALB1-RANKL15, SEQ ID NO: 710; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLVQAGGSLRLSCAAAGGT
FRNYVMGWFRQAPGKEREFVTAISTGGSWTGYVDSVKDRFTISRDNTKNTVYLQMASLKPEDTAVYYCAATT
PATTYLPRSERQYDYWGQGTQVTVSS

>RANKL9-ALB1-RANKL18, SEQ ID NO: 711; PRT; ->
EVQLVESGGGLVQAGGSLRLTCAASGRTFRSYAMGWFRQAPGKEREFVAAINYSGGSTNYADSVKGRFTISR
DNAKNTLYLQMNSLEPEDTAVYYCAAGSGYASLSYYSTERAYTYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLVQAGGSLRLSCAASGRT
FSRSAMGWFRQAPGKEREFVGFITGSGGTTYYGESVKGRFTISRDNAQNPVYLQMNSLKPEDTAVYYCGVYR
RIHISSTYSESSEYDYWGQGTQVTVSS

>RANKL13-ALB1-RANKL3, SEQ ID NO: 712; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGKLVQAGGSLRLSCAVSGRTS
SIYNMAWFRQGPGKGRESVGRIYWSDDNTYYADSVKGRFTISRDNATNTVYLQMNSLKPEDTAVYYCAGKTT
KWSLEYDYWGQGTQVTVSS

>RANKL13-ALB1-RANKL6, SEQ ID NO: 713; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLMQTGGSLRLSCAASGVTY
SYYTASWFRQAPGKEREFVAAISPSGNTYYADSVKGRFTISRDNGKHTMYLQMNSLNPEDTAVYFCAIRATD
SIYYASSYRHWGQGTQVTVSS

>RANKL13-ALB1-RANKL9, SEQ ID NO: 714; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLVQAGGSLRLTCAASGRTF
RSYAMGWFRQAPGKEREFVAAINYSGGSTNYADSVKGRFTISRDNAKNTLYLQMNSLEPEDTAVYYCAAGSG
YASLSYYSTERAYTYWGQGTQVTVSS

>RANKL130 | RANKL13-ALB1-RANKL13, SEQ ID NO: 715; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLVQAGGSLRLSCAASGRTF
RSYPMGWFRQAPGKEREFVASITGSGGSTYYADSVKGRFTISRDNAKNTVYLQMNSLRPEDTAVYSCAAYIR
PDTYLSRDYRKYDYWGQGTQVTVSS

>RANKL13-ALB1-RANKL15, SEQ ID NO: 716; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLVQAGGSLRLSCAAAGGTF
RNYVMGWFRQAPGKEREFVTAISTGGSWTGYVDSVKDRFTISRDNTKNTVYLQMASLKPEDTAVYYCAATTP
ATTYLPRSERQYDYWGQGTQVTVSS

>RANKL13-ALB1-RANKL18, SEQ ID NO: 717; PRT; ->
EVQLVESGGGLVQAGGSLRLSCAASGRTFRSYPMGWFRQAPGKEREFVASITGSGGSTYYADSVKGRFTISR
DNAKNTVYLQMNSLRPEDTAVYSCAAYIRPDTYLSRDYRKYDYWGQGTQVTVSSGGGGSGGGSEVQLVESGG
GLVQPGNSLRLSCAASGFTFRSFGSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLVQAGGSLRLSCAASGRTF
SRSAMGWFRQAPGKEREFVGFITGSGGTTYYGESVKGRFTISRDNAQNPVYLQMNSLKPEDTAVYYCGVYRR
THISSTYSESSEYDYWGQGTQVTVSS

TABLE B-4-continued

Trivalent bispecific NANOBODIES against RANK-L

```
<Name, SEQ ID #; PRT (protein); ->
Sequence

>RANKL15-ALB1-RANKL3, SEQ ID NO: 718; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGKLVQAGGSLRLSCAVSGRTS
SIYNMAWFRQGPGKGRESVGRIYWSDDNTYYADSVKGRFTISRDNATNTVYLQMNSLKPEDTAVYYCAGKTT
KWSLEYDYWGQGTQVTVSS

>RANKL15-ALB1-RANKL6, SEQ ID NO: 719; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLMQTGGSLRLSCAASGVTY
SYYTASWFRQAPGKEREFVAAISPSGNTYYADSVKGRFTISRDNGKHTMYLQMNSLNPEDTAVYFCAIRATD
SIYYASSYRHWGQGTQVTVSS

>RANKL15-ALB1-RANKL9, SEQ ID NO: 720; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLVQAGGSLRLTCAASGRTF
RSYAMGWFRQAPGKEREFVAAINYSGGSTNYADSVKGRFTISRDNAKNTLYLQMNSLEPEDTAVYYCAAGSG
YASLSYYSTERAYTYWGQGTQVTVSS

>RANKL15-ALB1-RANKL13, SEQ ID NO: 721; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLVQAGGSLRLSCAASGRTF
RSYPMGWFRQAPGKEREFVASITGSGGSTYYADSVKGRFTISRDNAKNTVYLQMNSLRPEDTAVYSCAAYIR
PDTYLSRDYRKYDYWGQGTQVTVSS

>RANKL150 | RANKL15-ALB1-RANKL15, SEQ ID NO: 722; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLVQAGGSLRLSCAAAGGTF
RNYVMGWFRQAPGKEREFVTAISTGGSWTGYVDSVKDRFTISRDNTKNTVYLQMASLKPEDTAVYYCAATTP
ATTYLPRSERQYDYWGQGTQVTVSS

>RANKL15-ALB1-RANKL18, SEQ ID NO: 723; PRT; ->
EVQLVESGGGLVQAGGSLRLSCAAAGGTFRNYVMGWFRQAPGKEREFVTAISTGGSWTGYVDSVKDRFTISR
DNTKNTVYLQMASLKPEDTAVYYCAATTPATTYLPRSERQYDYWGQGTQVTVSSGGGGSGGGSEVQLVESGG
GLVQPGNSLRLSCAASGFTFRSFGMSWVRQAPGKEPEWVSSISGSGSDTLYADSVKGRFTISRDNAKTTLYL
QMNSLKPEDTAVYYCTIGGSLSRSSQGTQVTVSSGGGGSGGGSEVQLVESGGGLVQAGGSLRLSCAASGRTF
SRSAMGWFRQAPGKEREFVGFITGSGGTTYYGESVKGRFTISRDNAQNPVYLQMNSLKPEDTAVYYCGVYRR
THISSTYSESSEYDYWGQGTQVTVSS

>RANKL18-ALB1-RANKL3, SEQ ID NO: 724; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTHISSTYSESSEYDYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGKLVQAGGSLRLSCAVSGRT
SSIYNMAWFRQGPGKGRESVGRIYWSDDNTYYADSVKGRFTISRDNATNTVYLQMNSLKPEDTAVYYCAGKT
TKWSLEYDYWGQGTQVTVSS

>RANKL18-ALB1-RANKL6, SEQ ID NO: 725; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTHISSTYSESSEYDYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLMQTGGSLRLSCAASGVT
YSYYTASWFRQAPGKEREFVAAISPSGNTYYADSVKGRFTISRDNGKHTMYLQMNSLNPEDTAVYFCAIRAT
DSIYYASSYRHWGQGTQVTVSS

>RANKL18-ALB1-RANKL9, SEQ ID NO: 726; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTHISSTYSESSEYDYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLVQAGGSLRLTCAASGRT
FRSYAMGWFRQAPGKEREFVAAINYSGGSTNYADSVKGRFTISRDNAKNTLYLQMNSLEPEDTAVYYCAAGS
GYASLSYYSTERAYTYWGQGTQVTVSS
```

TABLE B-4-continued

Trivalent bispecific NANOBODIES against RANK-L

<Name, SEQ ID #; PRT (protein); ->
Sequence

>RANKL18-ALB1-RANKL13, SEQ ID NO: 727; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTHISSTYSESSEYDYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLVQAGGSLRLSCAASGRT
FRSYPMGWFRQAPGKEREFVASITGSGGSTYYADSVKGRFTISRDNAKNTVYLQMNSLRPEDTAVYSCAAYI
RPDTYLSRDYRKYDYWGQGTQVTVSS

>RANKL18-ALB1-RANKL15, SEQ ID NO: 728; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTHISSTYSESSEYDYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLVQAGGSLRLSCAAAGGT
FRNYVMGWFRQAPGKEREFVTAISTGGSWTGYVDSVKDRFTISRDNTKNTVYLQMASLKPEDTAVYYCAATT
PATTYLPRSERQYDYWGQGTQVTVSS

>RANKL180 | RANKL18-ALB1-RANKL18, SEQ ID NO: 729; PRT; ->
EVQLVESGGGLVQAGGSLRLSCAASGRTFSRSAMGWFRQAPGKEREFVGFITGSGGTTYYGESVKGRFTISR
DNAQNPVYLQMNSLKPEDTAVYYCGVYRRTHISSTYSESSEYDYWGQGTQVTVSSGGGGSGGGSEVQLVESG
GGLVQPGNSLRLSCAASGFTFRSFGMSWVRQAPGKEPEWVSSISGSGSDTLYADSVKGRFTISRDNAKTTLY
LQMNSLKPEDTAVYYCTIGGSLSRSSQGTQVTVSSGGGGSGGGSEVQLVESGGGLVQAGGSLRLSCAASGRT
FSRSAMGWFRQAPGKEREFVGFITGSGGTTYYGESVKGRFTISRDNAQNPVYLQMNSLKPEDTAVYYCGVYR
RTYISSTYSESSEYDYWGQGTQVTVSS

TABLE B-5

Humanized NANOBODIES against RANK-L

<Name, SEQ ID #; PRT (protein); ->
Sequence

>RANKL6humbasic, SEQ ID NO: 730; PRT; ->
EVQLVESGGGLMQTGGSLRLSCAASGVTYSYYTASWFRQAPGKGREFVAAISPSGNTYYADSVKGRFTISR
DNGKHTLYLQMNSLRPEDTAVYFCAIRATDSIYYASSYRHWGQGTLVTVSS >RANKL6hum1, SEQ ID NO: 731; PRT; ->
EVQLVESGGGLVQTGGSLRLSCAASGVTYSYYTASWFRQAPGKGREFVAAISPSGNTYYADSVKGRFTISR
DNGKHTLYLQMNSLRPEDTAVYFCAIRATDSIYYASSYRHWGQGTLVTVSS >RANKL6hum2, SEQ ID NO: 732; PRT; ->
EVQLVESGGGLMQPGGSLRLSCAASGVTYSYYTASWFRQAPGKGREFVAAISPSGNTYYADSVKGRFTISR
DNGKHTLYLQMNSLRPEDTAVYFCAIRATDSIYYASSYRHWGQGTLVTVSS >RANKL6hum3, SEQ ID NO: 733; PRT; ->
EVQLVESGGGLMQTGGSLRLSCAASGVTYSYYTASWFRQAPGKGREFVAAISPSGNTYYADSVKGRFTISR
DNSKHTLYLQMNSLRPEDTAVYFCAIRATDSIYYASSYRHWGQGTLVTVSS >RANKL6hum4, SEQ ID NO: 734; PRT; ->
EVQLVESGGGLMQTGGSLRLSCAASGVTYSYYTASWFRQAPGKGREFVAAISPSGNTYYADSVKGRFTISR
DNGKNTLYLQMNSLRPEDTAVYFCAIRATDSIYYASSYRHWGQGTLVTVSS >RANKL6hum5, SEQ ID NO: 735; PRT; ->
EVQLVESGGGLMQTGGSLRLSCAASGVTYSYYTASWFRQAPGKGREFVAAISPS-GNTYYADSVKGRFTISR
DNGKHTLYLQMNSLRPEDTAVYFCAIRATDSIYYASSYRHWGQGTLVTVSS >RANKL9humbasic, SEQ ID NO: 736; PRT; ->
EVQLVESGGGLVQPGGSLRLTCAASGRTFRSYAMGWFRQAPGKGREFVAAINYSGGSTNYADSVKGRFTISR
DNAKNTLYLQMNSLEPEDTAVYYCAAGSGYASLSYYSTERAYTYWGQGTLVTVSS >RANKL9hum1, SEQ ID NO: 737; PRT; ->
EVQLVESGGGLVQPGGSLRLSCAASGRTFRSYAMGWFRQAPGKGREFVAAINYSGGSTNYADSVKGRFTISR
DNAKNTLYLQMNSLEPEDTAVYYCAAGSGYASLSYYSTERAYTYWGQGTLVTVSS >RANKL9hum2, SEQ ID NO: 738; PRT; ->
EVQLVESGGGLVQPGGSLRLTCAASGRTFRSYAMGWFRQAPGKGREFVSAINYSGGSTNYADSVKGRFTISR
DNAKNTLYLQMNSLEPEDTAVYYCAAGSGYASLSYYSTERAYTYWGQGTLVTVSS >RANKL9hum3, SEQ ID NO: 739; PRT; ->
EVQLVESGGGLVQPGGSLRLTCAASGRTFRSYAMGWFRQAPGKGREFVAAINYSGGSTNYADSVKGRFTISR
DNAKNTLYLQMNSLRPEDTAVYYCAAGSGYASLSYYSTERAYTYWGQGTLVTVSS TABLE B-5-continued Humanized NANOBODIES against RANK-L <Name, SEQ ID #; PRT (protein); ->
Sequence >RANKL18humbasic, SEQ ID NO: 740; PRT; ->
EVQLVESGGGLVQPGGSLRLSCAASGRTFSRSAMGWFRQAPGKGREFVGFITGSGGTTYYGESVKGRFTISR
DNAQNPVYLQMNSLRPEDTAVYYCGVYRRTYISSTYSESSEYDYWGQGTLVTVSS >RANKL18hum1, SEQ ID NO: 741; PRT; ->
EVQLVESGGGLVQPGGSLRLSCAASGRTFSRSAMGWFRQAPGKGREFVGFITGSGGTTYYGESVKGRFTISR
DNAQNTLYLQMNSLRPEDTAVYYCGVYRRTYISSTYSESSEYDYWGQGTLVTVSS >RANKL18hum2, SEQ ID NO: 742; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCGVYRRTYISSTYSESSEYDYWGQGTLVTVSS >RANKL18hum3, SEQ ID NO: 743; PRT; ->
EVQLVESGGGLVQPGGSLRLSCAASGFTFSRSAMGWFRQAPGKGREFVGFITGSGGTTYYGESVKGRFTISR
DNAQNPVYLQMNSLRPEDTAVYYCGVYRRTYISSTYSESSEYDYWGQGTLVTVSS >RANKL18hum4, SEQ ID NO: 744; PRT; ->
EVQLVESGGGLVQPGGSLRLSCAASGRTFSRSAMGWFRQAPGKGREFVSFITGSGGTTYYGESVKGRFTISR
DNAQNPVYLQMNSLRPEDTAVYYCGVYRRTYISSTYSESSEYDYWGQGTLVTVSS >RANKL18hum5, SEQ ID NO: 745; PRT; ->
EVQLVESGGGLVQPGGSLRLSCAASGRTFSRSAMGWFRQAPGKGREFVGFITGSGGTTYYGESVKGRFTISR
DNAQNPVYLQMNSLRPEDTAVYYCAVYRRTYISSTYSESSEYDYWGQGTLVTVSS >RANKL15humbasic, SEQ ID NO: 746; PRT; ->
EVQLVESGGGLVQPGGSLRLSCAAAGGTFRNYVMGWFRQAPGKGREFVTAISTGGSWTGYVDSVKDRFTISR
DNTKNTLYLQMASLRPEDTAVYYCAATTPATTYLPRSERQYDYWGQGTLVTVSS >RANKL15hum1, SEQ ID NO: 747; PRT; ->
EVQLVESGGGLVQPGGSLRLSCAAAGGTFRNYVMGWFRQAPGKGREFVTAISTGGSWTGYVDSVKDRFTISR
DNTKNTLYLQMASLRPEDTAVYYCAATTPATTYLPRSERQYDYWGQGTLVTVSS >RANKL15hum2, SEQ ID NO: 748; PRT; ->
EVQLVESGGGLVQPGGSLRLSCAAAGGTFRNYVMGWFRQAPGKGREFVTAISTGGSWTGYVDSVKDRFTISR
DNSKNTLYLQMASLRPEDTAVYYCAATTPATTYLPRSERQYDYWGQGTLVTVSS >RANKL15hum3, SEQ ID NO: 749; PRT; ->
EVQLVESGGGLVQPGGSLRLSCAAAGGTFRNYVMGWFRQAPGKGREFVTAISTGGSWTGYVDSVKDRFTISR
DNTKNTLYLQMASLRPEDTAVYYCAATTPATTYLPRSERQYDYWGQGTLVTVSS >RANKL13humbasic, SEQ ID NO: 750; PRT; ->
EVQLVESGGGLVQPGGSLRLSCAASGRTFRSYPMGWFRQAPGKGREFVASITGSGGSTYYADSVKGRFTISR
DNAKNTLYLQMNSLRPEDTAVYSCAAYIRPDTYLSRDYRKYDYWGQGTLVTVSS >RANKL13hum1, SEQ ID NO: 751; PRT; ->
EVQLVESGGGLVQPGGSLRLSCAASGFTFRSYPMGWFRQAPGKGREFVASITGSGGSTYYADSVKGRFTISR
DNAKNTLYLQMNSLRPEDTAVYSCAAYIRPDTYLSRDYRKYDYWGQGTLVTVSS >RANKL13hum1, SEQ ID NO: 752; PRT; ->
EVQLVESGGGLVQPGGSLRLSCAASGRTFSSYPMGWFRQAPGKGREFVASITGSGGSTYYADSVKGRFTISR
DNAKNTLYLQMNSLRPEDTAVYSCAAYIRPDTYLSRDYRKYDYWGQGTLVTVSS >RANKL13hum2, SEQ ID NO: 753; PRT; ->
EVQLVESGGGLVQPGGSLRLSCAASGRTFRSYPMGWFRQAPGKGREFVSSITGSGGSTYYADSVKGRFTISR
DNAKNTLYLQMNSLRPEDTAVYSCAAYIRPDTYLSRDYRKYDYWGQGTLVTVSS >RANKL13hum3, SEQ ID NO: 754; PRT; ->
EVQLVESGGGLVQPGGSLRLSCAASGRTFRSYPMGWFRQAPGKGREFVASITGSGGSTYYADSVKGRFTISR
DNAKNTLYLQMNSLRPEDTAVYYCAAYIRPDTYLSRDYRKYDYWGQGTLVTVSS >RANKL13hum5, SEQ ID NO: 755; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSS >RANKL13hum5_D62E, SEQ ID NO: 756; PRT; ->
EVQLVESGGGLVQPGGSLRLSCAASGFTFSSYPMGWFRQAPGKGREFVSSITGSGGSTYYAESVKGRFTISR
DNAKNTLYLQMNSLRPEDTAVYYCAAYIRPDTYLSRDYRKYDYWGQGTLVTVSS >RANKL18hum6, SEQ ID NO: 757; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSS

TABLE B-5-continued

Humanized NANOBODIES against RANK-L

<Name, SEQ ID #; PRT (protein); ->
Sequence

>RANKL18hum7, SEQ ID NO: 765; PRT; ->
EVQLVESGGGLVQPGGSLRLSCAASGRTFSRSAMGWFRQAPGKGREFVGFITGSGGTTYYADSVKGRFTISR
DNAQNPLYLQMNSLRPEDTAVYYCAVYRRTYISSTYSESSEYDYWGQGTLVTVSS

TABLE B-6

Constructs of the humanized NANOBODIES against RANK-L

<Name, SEQ ID #; PRT (protein); ->
Sequence

RANKL001p, SEQ ID NO: 761; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGGSEVQLVESGG
GLVQPGGSLRLSCAASGFTFSSYPMGWFRQAPGKGREFVSSITGSGGSTYYADSVKGRFTISRDNAKNTLYL
QMNSLRPEDTAVYYCAAYIRPDTYLSRDYRKYDYWGQGTLVTVSSGGGC

RANKL003p, SEQ ID NO: 762; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGGSGGGGSGG
GGSGGGGSGGGGSEVQLVESGGGLVQPGGSLRLSCAASGRTFSRSAMGWFRQAPGKGREFVGFITGSGGTTY
YADSVKGRFTISRDNAQNPVYLQMNSLRPEDTAVYYCAVYRRTYISSTYSESSEYDYWGQGTLVTVSSGGGC

RANKL18hum6bi_25 | RANKL18hum6-25GS-RANKL18hum6, SEQ ID NO: 768; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGGSGGGGSGG
GGSGGGGSEVQLVESGGGLVQPGGSLRLSCAASGRTFSRSAMGWFRQAPGKGREFVGFITGSGGTTYYADSV
KGRFTISRDNAQNPVYLQMNSLRPEDTAVYYCAVYRRTYISSTYSESSEYDYWGQGTLVTVSS RANKL18hum6bi_30 | RANKL18hum6-30GS-RANKL18hum6, SEQ ID NO: 769; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGGSGGGGSGG
GGSGGGGSGGGGSEVQLVESGGGLVQPGGSLRLSCAASGRTFSRSAMGWFRQAPGKGREFVGFITGSGGTTY
YADSVKGRFTISRDNAQNPVYLQMNSLRPEDTAVYYCAVYRRTYISSTYSESSEYDYWGQGTLVTVSS RANKL004h | RANKL13hum5-9GS-RANKL13hum5-HSA, SEQ ID NO: 772; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGGSEVQLVESGG
GLVQPGGSLRLSCAASGFTFSSYPMGWFRQAPGKGREFVSSITGSGGSTYYADSVKGRFTISRDNAKNTLYL
QMNSLRPEDTAVYYCAAYIRPDTYLSRDYRKYDYWGQGTLVTVSSDAHKSEVAHRFKDLGEENFKALVLIAF
AQYLQQCPFEDHVKLVNEVTEFAKTCVADESAENCDKSLHTLFGDKLCTVATLRETYGEMADCCAKQEPERN
ECFLQHKDDNPNLPRLVRPEVDVMCTAFHDNEETFLKKYLYEIARRHPYFYAPELLFFAKRYKAAFTECCQA
ADKAACLLPKLDELRDEGKASSAKQRLKCASLQKFGERAFKAWAVARLSQRFPKAEFAEVSKLVTDLTKVHT
ECCHGDLLECADDRADLAKYICENQDSISSKLKECCEKPLLEKSHCIAEVENDEMPADLPSLAADFVESKDV
CKNYAEAKDVFLGMFLYEYARRHPDYSVVLLLRLAKTYETTLEKCCAAADPHECYAKVFDEFKPLVEEPQNL
IKQNCELFEQLGEYKFQNALLVRYTKKVPQVSTPTLVEVSRNLGKVGSKCCKHPEAKRMPCAEDYLSVVLNQ
LCVLHEKTPVSDRVTKCCTESLVNRRPCFSALEVDETYVPKEFNAETFTFHADICTLSEKERQIKKQTALVE
LVKHKPKATKEQLKAVMDDFAAFVEKCCKADDKETCFAEEGKKLVAASQAALGL RANKL006h | RANKL18hum6-30GS-RANKL18hum6-HSA, SEQ ID NO: 773; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGGSGGGGSGG
GGSGGGGSGGGGSEVQLVESGGGLVQPGGSLRLSCAASGRTFSRSAMGWFRQAPGKGREFVGFITGSGGTTY
YADSVKGRFTISRDNAQNPVYLQMNSLRPEDTAVYYCAVYRRTYISSTYSESSEYDYWGQGTLVTVSSDAHK
SEVAHRFKDLGEENFKALVLIAFAQYLQQCPFEDHVKLVNEVTEFAKTCVADESAENCDKSLHTLFGDKLCT
VATLRETYGEMADCCAKQEPERNECFLQHKDDNPNLPRLVRPEVDVMCTAFHDNEETFLKKYLYEIARRHPY
FYAPELLFFAKRYKAAFTECCQAADKAACLLPKLDELRDEGKASSAKQRLKCASLQKGSERAFKAWAVARLS
QRFPKAEFAEVSKLVTDLTKVHTECCHGDLLECADDRADLAKYICENQDSISSKLKECCEKPLLEKSHCIAE
VENDEMPADLPSLAADFVESKDVCKNYAEAKDVFLGMFLYEYARRHPDYSVVLLLRLAKTYETTLEKCCAAA
DPHECYAKVFDEFKPLVEEPQNLIKQNCELFEQLGEYKFQNALLVRYTKKVPQVSTPTLVEVSRNLGKVGSK
CCKHPEAKRMPCAEDYLSVVLNQLCVLHEKTPVSDRVTKCCTESLVNRRPCFSALEVDETYVPKEFNAETFT
FHADICTLSEKERQIKKQTALVELVKHKPKATKEQLKAVMDDFAAFVEKCCKADDKETCFAEEGKKLVAASQ
AALGL RANKL008a, SEQ ID NO: 759; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGGSEVQLVESGG
GLVQPGNSLRLSCAASGFTFSSFGMSWVRQAPGKGLEWVSSISGSGSDTLYADSVKGRFTISRDNAKTTLYL
QMNSLRPEDTAVYYCTIGGSLSRSSQGTLVTVSSGGGGSGGGSEVQLVESGGGLVQPGGSLRLSCAASGFTF
SSYPMGWFRQAPGKGREFVSSITGSGGSTYYADSVKGRFTISRDNAKNTLYLQMNSLRPEDTAVYYCAAYIR
PDTYLSRDYRKYDYWGQGTLVTVSS TABLE B-6-continued Constructs of the humanized NANOBODIES against RANK-L <Name, SEQ ID #; PRT (protein); ->
Sequence RANKL010a, SEQ ID NO: 760; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGSEVQLVESG
GGLVQPGNSLRLSCAASGFTFSSFGMSWVRQAPGKGLEWVSSISGSGSDTLYADSVKGRFTISRDNAKTTLY
LQMNSLRPEDTAVYYCTIGGSLSRSSQGTLVTVSSGGGGSGGGSEVQLVESGGGLVQPGGSLRLSCAASGRT
FSRSAMGWFRQAPGKGREFVGFITGSGGTTYYADSVKGRFTISRDNAQNPVYLQMNSLRPEDTAVYYCAVYR
RTYISSTYSESSEYDYWGQGTLVTVSS RANKL13hum5-IgG1_1, SEQ ID NO: 774; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGSGGGGSGGGS
EPKSSDKTHTCPPCPAPELLGGPSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKIISKAKGQPREPQVYTLPPSRDELT
KNQVSLTCLVKGFYPSDIAVEWESNGQPENNYKTTPPVLDSDGPFFLYSKLTVDKSRWQQGNVFSCSVMHEA
LHNHYIQKSLSLSPGK RANKL13hum5-IgG1_2, SEQ ID NO: 775; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGSGGGGSGGGS
GGGGSDKTHTCPPCPAPELLGGPSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQPREPQVYTLPPSRDELT
KNQVSLTCLVKGFYPSDIAVEWESNGQPENNYKTTPPVLDSDGPFFLYSKLTVDKSRWQQGNVFSCSVMHEA
LHNHYTQKSLSLSPGK RANKL13hum5-IgG1_3, SEQ ID NO: 776; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGSGGGGSGGGS
GGGGSGGGGSCPPCPAPELLGGPSVFLFPPKPKDTLMISRTPEVTCVVVDVSHEDPEVKFNWYVDGVEVHNA
KTKPREEQYNSTYRVVSVLTVLHQDWLNGKEYKCKVSNKALPAPIEKTISKAKGQPREPQVYTLPPSRDELT
KNQVSLTCLVKGFYPSDIAVEWESNGQPENNYKTTPPVLDSDGPFFLYSKLTVDKSRWQQGNVFSCSVMHEA
LHNHYIQKSLSLSPGK RANKL13hum5-IgG1_4, SEQ ID NO: 777; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSCPPCPAPELLGGPSVFLF
PPKPKDTLMISRTPEVTCVVVDVSHEDPEVKFNWYVDOVEVHNAKTKPREEQYNSTYRVVSVLTVLHQDWLN
GKEYKCKVSNKALPAPIEKTISKAKGQPREPQVYTLPPSRDELTKNQVSLTCLVKGFYPSDIAVEWESNGQP
ENNYKTTPPVLDSDGPFFLYSKLTVDKSRWQQGNVFSCSVMHEALHNHYTQKSLSLSPGK RANKL13hum5-IgG2_1, SEQ ID NO: 778; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGSGGGGSGGGS
GGGSERKCCVECPPCPAPPVAGPSVFLFPPKPKDTLMISRTPEVTCVVVDVSHEDPEVQFNWYVDGMEVHNA
KTKPREEQFNSTFRVVSVLTVVHQDWLNGKEYKCKVSNGSLPAPIEKTISKTKGQPREPQVYTLPPSREEMT
KNQVSLTCLVKSFYPSDIAVEWESNSQPENNYKTTPPMLDSDGSFFLYSKLTVDKSRWQQGNVFSCSVMHEA
LHNHYTQKSLSLSPGK RANKL13hum5-IgG2_2, SEQ ID NO: 779; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGSGGGGSGGGS
GGGGSGGGSGGSCCVECPPCPAPPVAGPSVFLFPPKPKDTLMISRTPEVTCVVVDVSHEDPEVQFNWYVDGM
EVHNAKTKPREEQFNSTFRVVSVLTVVHQDWLNGKEYKCKVSNKGLPAPIEKTISKTKGQPREPQVYTLPPS
REEMTKNQVSLTCLVKGFYPSDIAVEWESNGQPENNYKTTPPMLDSDGSFFLYSKLTVDKSRWQQGNVFSCS
VMHEALHNHYTQKSLSLSPGK RANKL13hum5-IgG2_3, SEQ ID NO: 780; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGSGGGGSGGGS
GGGGSGGGSGGGSCCVECPPCPAPPVAGPSVFLFPPKPKDTLMISRTPEVTCVVVDVSHEDPEVQFNWY
VDGMEVHNAKTKPREEQFNSTFRVVSVLTVVHQDWLNGKEYKCKVSNKGLPAPIEKTISKTSQPREPQVYT
LPPSREEMTKNQVSLTCLVKGFYPSDIAVEWESNGQPENNYKTTPPMLDSDGSFFLYSKLTVDKSRWQQGNV
FSCSVMHEALHNHYTQKSLSLSPGK RANKL13hum5-IgG2_4, SEQ ID NO: 781; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSCCVECPPCPAPPVAGPSV
FLFPPKPKDTLMISRTPEVTCVVVDVSHEDPEVQFNWYVDGMEVHNAKTKPREEQFNSTFRVVSVLTVVHQD
WLNGKEYKCKVSNKGLPAPIEKTISKTKGQPREPQVYTLPPSREEMTKNQVSLTCLVKGFYPSDIAVEWESN
GQPENNYKTTPPMLDSDGSFFLYSKLTVDKSRWQQGNVFSCSVMHEALHNHYTQKSLSLSPGK RANKL18hum6-IgG1_1, SEQ ID NO: 782; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGSGGGGSGGG
SEPKSSDKTHTCPPCPAPELLGGPSVFLFPPKPKDTLMISRTPEVTCVVVDVSHEDPEVKFNWYVDGVEVHN TABLE B-6-continued Constructs of the humanized NANOBODIES against RANK-L <Name, SEQ ID #; PRT (protein); ->
Sequence AKTKPREEQYNSTYRVVSVLTVLHQDWLNGKEYKCKVSNKALPAPIEKTISKAKGQPREPQVYTLPPSRDEL
TKNQVSLTCLVKGFYPSDIAVEWESNGQPENNYKTTPPVLDSDGPFFLYSKLTVDKSRWQQGNVFSCSVMHE
ALHNHYTQKSLSLSPGK RANKL18hum6-IgG1_2, SEQ ID NO: 783; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGSGGGGSGGG
SGGGGSDKTHTCPPCPAPELLGGPSVFLFPPKPKDTLMISRTPEVTCVVVDVSHEDPEVKFNWYVDGVEHN
AKTKPREEQYNSTYRVVSVLTVLHQDWLNGKEYKCKVSNKALPAPIEKTISKAKGQPREPQVYTLPPSRDEL
TKNQVSLTCLVKGFYPSDIAVEWESNGQPENNYKTTPPVLDSDGPFFLYSKLTVDKSRWQQGNVFSCSVMHE
ALHNHYTQKSLSLSPGK RANKL18hum6-IgG1_3, SEQ ID NO: 784; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGSGGGGSGGG
SGGGGSGGGGSCPPCPAPELLGGPSVFLFPPKPKDTLMISRTPEVTCVVVDVSHEDPEVKFNWYVDGVEHN
AKTKPREEQYNSTYRVVSVLTVLHQDWLNGKEYKCKVSNKALPAPIEKTISKAKGQPREPQVYTLPPSRDEL
TKNQVSLTCLVKGFYPSDIAVEWESNGQPENNYKTTPPVLDSDGPFFLYSKLTVDKSRWQQGNVFSCSVMHE
ALHNHYTQKSLSLSPGK RANKL18hum6-IgG1_4, SEQ ID NO: 785; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSCPPCPAPELLGGPSVFL
FPPKPKDTLMISRTPEVTCVVVDVSHEDPEVKFNWYVDGVEHNAKTKPREEQYNSTYRVVSVLTVLHQDWL
NGKEYKCKVSNKALPAPIEKTISKAKGQPREPQVYILPPSRDELTKNQVSLTCLVKGFYPSDIAVEWESNGQ
PENNYKTTPPVLDSDGPFFLYSKLTVDKSRWQQGNVFSCSVMHEALHNHYTQKSLSLSPGK RANKL18hum6-IgG2_1, SEQ ID NO: 786; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGSGGGGSGGG
SGGGSERKCCVECPPCPAPPVAGPSVFLFPPKPKDTLMISRTPEVTCVVVDVSHEDPEVQFNWYVDGMEVHN
AKTKPREEQFNSTFRVVSVLTVVHQDWLNGKEYKCKVSNKGLPAPIEKTISKTKGQPREPQVYTLPPSREEM
TKNQVSLTCLVKGFYPSDIAVEWESNGQPENNYKTTPPMLDSDGSFFLYSKLTVDKSRWQQGNVFSCSVMHE
ALHNHYTQKSLSLSPGK RANKL18hum6-IgG2_2, SEQ ID NO: 787; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGSGGGGSGGG
SGGGGSGGGSGGSCCVECPPCPAPPVAGPSVFLFPPKPKDTLMISRTPEVTCVVVDVSHEDPEVQFNWYVDG
MEVHNAKTKPREEQFNSTFRVVSVLTVVHQDWLNGKEYKCKVSNKGLPAPIEKTISKTKGQPREPQVYTLPP
SREEMTKNQVSLTCLVKGFYPSDIAVEWESNGQPENNYKTTPPMLDSDGSFFLYSKLTVDKSRWQQGNVFSC
SVMHEALHNHYTQKSLSLSPGK RANKL18hum6-IgG2_3, SEQ ID NO: 788; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSGGGGSGGGSGGGGSGGG
SGGGGSGGGSGGGSGGSCCVECPPCPAPPVAGPSVFLFPPKPKDTLMISRTPEVTCVVVDVSHEDPEVQFNW
YVDGMEVHNAKTKPREEQFNSTFRVVSVLTVVHQDWLNGKEYKCKVSNKGLPAPIEKTISKTKGQPREPQVY
TLPPSREEMTKNQVSLTCLVKGFYPSDIAVEWESNGQPENNYKTTPPMLDSDGSFFLYSKLTVDKSRWQQGN
VFSCSVMHEALHNHYTQKSLSLSPGK RANKL18hum6-IG2_4, SEQ ID NO: 789; PRT; ->
EVQLVESGGGLVQPGGSLRLSCAASGRTFSRSAMGWFRQAPGKGREFVGFITGSGGTTYYADSVKGRFTISR
DNAQNPVYLQMNSLRPEDTAVYYCAVYRRTYISSTYSESSEYDYWGQGTLVTVSSCCVECPPCPAPPVAGPS
VFLFPPKPKDTLMISRTPEVTCVVVDVSHEDPEVQFNWYVDGMEVHNAKTKPREEQFNSTFRVVSVLTVVHQ
DWLNGKEYKCKVSNKGLPAPIEKIISKTKGQPREPQVYTLPPSREEMTKNQVSLTCLVKGFYPSDIAVEWES
NGQPENNYKTTPPMLDSDGSFFLYSKLTVDKSRWQQGNVFSCSVMHEALHNHYTQKSLSLSPGK CabLys3-Alb11-13H5, SEQ ID NO: 815; PRT; ->
DVQLQASGGGSVQAGGSLRLSCAASGYTIGPYCMGWFRQAPGKEREGVAAINMGGGITYYADSVKGRFTISQ
DNAKNTVYLLMNSLEPEDTAIYYCAADSTIYASYYECGHGLSTGGYGYDSWGQGTQVTVSSGGGGSGGGSEV
QLVESGGGLVQPGNSLRLSCAASGFTFSSFGMSWVRQAPGKGLEWVSSISGSGSDTLYADSVKGRFTISRDN
AKTTLYLQMNSLRPEDTAVYYCTIGGSLSRSSQGTLVTVSSGGGGSGGGSEVQLVESGGGLVQPGGSLRLSC
AASGFTFSSYPMGWFRQAPGKGREFVSSITGSGGSTYYADSVKGRFTISRDNAKNTLYLQMNSLRPEDTAVY
YCAAYIRPDTYLSRDYRKYDYWGQGTLVTVSS 13H5-CabLys3-13H5, SEQ ID NO: 816; PRT; ->
EVQLVESGGGLVQPGGSLRLSCAASGFTFSSYPMGWFRQAPGKGREFVSSITGSGGSTYYADSVKGRFTISR
DNAKNTLYLQMNSLRPEDTAVYYCAAYIRPDTYLSRDYRKYDYWGQGTLVTVSSGGGGSGGGSDVQLQASGG
GSVQAGGSLRLSCAASGYTIGPYCMGWFRQAPGKEREGVAAINMGGGITYYADSVKGRFTISQDNAKNTVYL
LMNSLEPEDTAIYYCAADSTIYASYYECGHGLSTGGYGYDSWGQGTQVTVSSGGGGSGGGSEVQLVESGGGL
VQPGGSLRLSCAASGFTFSSYPMGWFRQAPGKGREFVSSITGSGGSTYYADSVKGRFTISRDNAKNTLYLQM
NSLRPEDTAVYYCAAYIRPDTYLSRDYRKYDYWGQGTLV

TABLE B-7

NANOBODIES against human serum albumin

| Name | Sequence | SEQ ID NO |
|---|---|---|
| ALB-1 | EVQLVESGGGLVQPGNSLRLSCAASGFTFRSFGMSWVRQAPGKEP EWVSSISGSGSDTLYADSVKGRFTISRDNAKTTLYLQMNSLKPEDT AVYYCTIGGSLSRSSQGTQVTVSS | 790 |
| ALB-12 | EVQLVESGGGLVQPGNSLRLSCAASGFTFSSFGMSWVRQAPGKGL EWVSSISGSGSDTLYADSVKGRFTISRDNAKTTLYLQMNSLRPEDT AVYYCTIGGSLSRSSQGTLVTVSS | 791 |

TABLE B-8

Linkers used in the NANOBODY constructs

| Linker | Sequence | SEQ ID NO |
|---|---|---|
| 9GS linker | GGGGSGGGS | 792 |
| 15GS linker | ggggsggggsggggs | 793 |
| 20GS linker | GGGGSGGGGSGGGGSGGGGS | 794 |
| 25GS linker | ggggsggggsggggsggggsggggs | 795 |
| 30GS linker | GGGGSGGGGSGGGGSGGGGSGGGGSGGGGS | 796 |

TABLE C-1

Anti-RANK-L NANOBODY sequences obtained as described in Example 1. The Nanobody sequences are grouped by family. Unique sequences are indicated.

UNIQUE SEQUENCES

```
RANKLPMP2G8 (RANKL3)
evqlvesggklvqaggslrlscavsgrtss--
IYNMAwfrqgpgkgresvgRIYWSDDNTYYADSVKGrftisrdnatntvylqmnslkpedtavyycagKTTKWSLEYDY-------wgqgtqvtvss
RANKLPMP2B9 (RANKL2)
evqlvesggglvqpggslrlscaasgftfs--
SYYMSwvrqapgkglewvsSIYSDGSTTDYADSVKGrftisrdnakntlnlqmnslksedtavyycakDANSGGLEYDY-------wgqgtqvtvss
RANKLPMP4H9 (RANKL6)
evqlvesggglmqtggslrlscaasgvtys--YYTASwfrqapgkerefvaAISPSG-
NTYYADSVKGrftisrdngkhtmylqmnslnpedtavyfcaiRATDSIYYASSYRH----wgqgtqvtvss
RANKLPMP4G8 (RANKL5)
evqlvesggglvqaggslrlscaasgrtig--
GPTMAwfrqapgkerdfvaSITSSGSTIFYADSVKGrftisrdngkktmtlemdslkpedtavyycaaKIRGKVTVDYFDYAY---wgqgtqvtvss
RANKLPMP7B4 (RANKL7)
evqlveseggpvqsggslrlscaasgrtfs--
vstiawfrqapgegrefvaaiypsgrnayvadsvkgrftisrdnakktvylqmnslkpedtaayycaahqpsgsyysaeayay---wgqgtqvtvss
RANKLPMP9F10 (RANKL11)
evqlvesggglvqaggslrlscaasgrtfs--
SKTMGwfrqppgnerefvaAITPTSRTTYYADSVKGrftisrdnakntvslqmnslkfedtaayycvaVRRYGSPPHDGSSYEY--wgqgtqvtvss
RANKLPMP9B3 (RANKL10)
evqlvesggglvqaggslrlscaasgitfs--
SRTMGwfrqapgkerefvaAITPSSRTTYYADSVKGrftisrdnakntvllqmnslkpedtavyycaaERTYGSNYTRPTAWNY--wgqgtqvtvss
RANKLPMP4F12 (RANKL4)
kvqlvesggglvqtgdslrlscaasgraig--
SYAMGwfrqapgkerefvaVINYRGSSLKYADRVKGrftisrdnaknmvylqmnslpddtavyycaaQTSGADFGTTPQRYTY--wgqgtqvtvss
RANKLPMP9B1 (RANKL1)
evqlvesggglvqaggslrlscavsgrtfs--
SSTMAwfrqppggerdfvaSISTSGTRTLYADSVKGrftisrdnakstgylqmnslkpedtavyfcaaVNRRGWEFWRLASGYDY-wglgaqvtvss
RANKLPMP7E3 (RANKL8)
evqlvesgggsvqpggslrlscaasggtfs--
RYAMGwfrqapgkerefvsAISVGGTYQYYVDSVKGrftisrdnaestvylqmnslkpedtavyycagDASPYGYLREYTATRFDYwgqgtqvtvss
RANKLPMP8A11 (RANKL9)
evqlvesggglvqaggslrltcaasgrtfr--
SYAMGwfrqapgkerefvaAINYSGGSTNYADSVKGrftisrdnakntlylqmnslepedtavyycaaGSGYASLSYYSTERAYTYwgqgtqvtvss

FAMILIES
FAMILY 1

RANKLPMP9B6 (RANKL12)
evqlvesgggwmqaggslrlscaasgrtft-----
MAwfrqapgkerefvaAITGSGRSTYYTDSVKGrftisrdnakntaylqmkslkpedtavyycagLRGLG-LEYDSAKS-YSYwgqgtqvtvss
RANKLPMP4B3
evqlvesgggwmqaggslrlscaasgrtft-----
MAwfrqasgkerefvaAITGSGRSTYYTDSVKGrftisrdnakntaylqmkslkpedtavyycagLRGLG-LEYDSAKS-YSYwgqgtqvtvss
```

TABLE C-1-continued

Anti-RANK-L NANOBODY sequences obtained as described in Example 1. The
Nanobody sequences are grouped by family. Unique sequences are indicated.

FAMILY 2

RANKLPMP1C7 (RANKL13)
evqlvesggglvqaggslrlscaasgrtfr--
SYPMGwfrqapgkerefvaSITGSGGSTYYADSVKGrftisrdnakntvylqmnslrpedtavyscaaYIRPDTYLSRDYRKYDY-wgqgtqvtvss
RANKLPMP2E11
EV*LVESGGGLVQAGGSLRLSCAASGRTFR--
SYPMGWFRQAPGKEREFVASITGSGGSTYYADSVKGRFTISRDNAKNTVYLQMNSLRPEDTAVYSCAAYIRPDTYLSRDYRKYDY-WGQGTQVTVSS

FAMILY 3

RANKLPMP2A6
evqlvesggglvqaggslrlscaasgltss--RYTMSwfrqdpgkerefvaAVPLSG-
NTYYADPVRGrftisrdnakntvdlqmnslkpedtavyycaaRASGSIFNRGS----YAYwgqgtqvtvss
RANKLPMP6B8 (RANKL14)
evqlvesggglvqaggslrlscaasgrtss--YYTMSwfrqdpgkerefvaAVPLSG-
NTYYADPVRGrftisrdnakntadlqmnslkpedtavyycaaRASGSIYNRGS----YAYwgqgtqvtvss
RANKLPMP1F2
evqlvesggglvpaggslrlscaasgltdr--RYTMSwfrqdpgkerefvaAVPLSG-
NTYYADPVRGrftisrdnakntvdlqmnslkpedtavyycaaRASGSIFNRGS----YAYwgqgtqvtvss
RANKLPMP2D4
evqlvesggglvpaggslrlscaasgltdr--RYTMSwfrqdpgkerefvaAVPLSG-
NTYYADPVRGrftisrdnakntvdlqmnslkpedtavyycaaRASGSIFNRGS----YAYwgqgtqvtvss

FAMILY 4

RANKLPMP7B2
evqlvesggglvqaggslrlscaaaggtfr--
NYVMGwfrqapgkerefvtAISTGGSWTGYVDSVKDrftisrdntkntvylqmaslkpedtavyycaaTMPATTYLPR-SERQYDYwgqgtqvtvss
RANKLPMP7C5 (RANKL15)
evqlvesggglvqaggslrlscaaaggtfr--
NYVMGwfrqapgkerefvtAISTGGSWTGYVDSVKDrftisrdntkntvylqmaslkpedtavyycaaTTPATTYLPR-SERQYDYwgqgtqvtvss
RANKLPMP7A11
evqlvesggglvqaggsltlscaaagftfr--
RYVMGwfrqapgkerefvaAISTGGTWTGYVDSVKDrftisrdntkntvylqmaslkpedtavyncaaTTPTTSYLPR-SERQYEYwgqgtqvtvss
RANKLPMP7F1
evqlvesggglvqaggslrlscaaagctfr--
NYVMGwfrqapgkerefvtAISTGGTWTGYVDSVKDrftisrdntkntvnlqmaslkpedtavyycaaTTPTTSYLPR-SERQYEYwgqgtqvtvss
RANKLPMP7H5
evqlvesggglvqaggslrlscaaaggtfr--
NYVMGwfrqapgkerefvtAISTGGSWTGYVDSVKDrftisrdntkntvylqmvslkpedtavyycaaTTPATTYLPR-SERQYDYwgqgtqvtvss
RANKLPMP7E7
evqlvesggglvqaggslrlscaaaggtfr--
NYVMGwfrqapgkerefvtAISAGGSWTGYVDSVKDrftisrdntkntvylqmaslkpedtavyycaaTTPATTYLPR-SERQYDYwgqgtqvtvss
RANKLPMP7E2
evqlvesggglvqaggslrlscaaagytfr--
AYVMGwfrqapgkerefvaGISTGGTWTGYVDSVKDrftisrdntkntvylqmaslkpedtavyycaaTTPVTSYLPR-SERQYEHwgqgtqvtvss
RANKLPMP3H10
evqlvesggglvqsggslrlscaaagytfrARAYVMGwfrqapgkerefvaAISTGGTWTGYVDSVKDrftisrdntkntmylqmaslkpedtavy
ycaaTTPSTSYLPR-SERQYEYwgqgtqvtvss
RANKLPMP7F8
EVQLVESGGGLVQAGGSLRLSCAAAGGTFR--
NYVMGWFRQAPGKEREFVTAISTGGSWTGYVDSVKDRFTISRDNTKNTVYLHMASLKPEDTAVYYCAATTPVTTYLPR-SERQYDYWGQGTQVTVSS
RANKLPMP7F6
EVQLVESGGGLVQAGDSLRLSCAAAGFTFR--
RYVMGWFRQAPGKEREFVAAISTGGTWTGYVDSVKDRFTISRDNTKNTVYLQMASLKPEDTAVYNCAATTPTTSYLPR-SERQYEYWGQGTQVTVSS

FAMILY 5

RANKLPMP7G8 (RANKL5)
evqlvesggglvqaggslrlscvasrrtfs--SYAMGwfrqvpgkerdfvaAISTG-
SITTYGDSVKGrftisrdnakntvylqmnslkpedtavyycaaGKREPYLRQYTASNPYDYwgqgtqvtvss
RANKLPMP7F9
evqlvesggglvqaggslrlscvasrrtfs--SYAMGwfrqvpgkerdfvaAISTG-
SITTYGDSVKGrftisrdnakntvylqmnslkpedtavyycaaGKREPYLRQYTASNPYDYwgqgtqvtvss
RANKLPMP7E6
evqlvesggglvqaggslrlscvaskrtfa--SYAMGwfrqvpgkerdfvaAITTG-
SITTYADSVKGrfaisrdnakntvylqmnslkpedtavyycaaGNREPYLRQYTASNPYDYwgqgtqvtvss

FAMILY 6

RANKLPMP4F4
evqlvesggglvqvgdslrlsceasgrsrf-
STYVMGwfrqapgkerefvaAVSWSSGNAYYIDSAKGrfatsrdtaknimylqmnslkpedtavytcaaGRGYGLLSEYTQAPRYDYwgqgtqvtvss
RANKLPMP9C2 (RANKL17)
evqlvesggglvqvgdslrlsceasgrsrf- TABLE C-1-continued Anti-RANK-L NANOBODY sequences obtained as described in Example 1. The
Nanobody sequences are grouped by family. Unique sequences are indicated.

STYVMGwfrqapgkerefvaAVSWSSGNAYYIDSAKGrfatsrdtaknimylqmnslkpedtavytcaaGRGYGLLSEYTQAPRYDYwgqgtqvtvss
RANKLPMP7B11
evqlvesggglvqvgdslrlsceasgrsrf-
STYVMGwfrqapgkerefvaAISWSSGNAYYIDSAKGrfatsrdtaknimylqmnslkpedtavyscaaGRGYGLLSEYTQAARYDYwgqgtqvtvss

FAMILY 7

RANKLPMP9H9
evqlvesggglvqaggslrlscaasgrtfs--
RSAMGwfrqapgkerefvgFITGSGGTTYYGESVKGrftisrdnaqnpvylqmnslkpedtavyycgvYRRTYISSTYSESSEYDYwgqgtqvtvss
RANKLPMP9G3
evqlvesggglvqaggslrlscaasgrtfs--
RSAMGwfrqapgkerefvgFITGSGGTTYYGESVKGrftisrdnaqnpvylqmnslkpedtavyycavYRRTYISSTYNESSEYDYwgqgtqvtvss
RANKLPMP9E3
evqlvesggglvqaggslrlscaasgrtfs--
RSAMGwfrqapgkerefvgFITGSGGTTYYGESVKGrftisrdnaqnpvylqmnslkpedtavyycgvYRRTYISSTYSESSEYDYwgqgtqvtvss
RANKLPMP7H9
evqlvesggglvqaggslrlscaasgrtfs--
RSAMGwfrqapgkerefvgFITGSGGTTYYGESVKGrftisrdnaqnpvylqmnslkpedtavyycgvYRRTYISITYSESSDYDYwgqgtqvtvss
RANKLPMP4C3
evqlvesggglvqaggslrlscaasgrtfs--
ISAMGwfrqapgkerefvcFITGSGGTTYYGESVKGrftisrdnaqnpvylqmnslkpedtavyycgvYRRTYISSTYSESSEYDYwgqgtqvtvss
RANKLPMP9G6
evqlvesggglvqaggslrlscaasgrtfs--
RSAMGwfrqapgkerefvgFITGSGGTTYYGESVKGrftisrdnaqnpvylqmnslkpedtavyycgvYRRTYISSTYSESSEYDYwgqgtqvtvss
RANKLPMP7F11 (RANKL18)
evqlvesggglvqaggslrlscaasgrtfs--
RSAMGwfrqapgkerefvgFITGSGGTTYYGESVKGrftisrdnaqnpvylqmnslkpedtavyycgvYRRTYISSTYSESSEYDYwgqgtqvtvss
RANKLPMP7B12
evqlvesggglvqaggslrlscaasgrtfs--
RSAMGwfrqapgkerefvgFITGSGGTTYYGESVKGrftisrdnaqnpvylqmnslkpedtavyycgvYRRTYISSTYSESSEYDYwgqgtqvtvss
RANKLPMP7G3
evqlvesggglvqaggslrlscaasgrtfs--
RSAMGwfrqapgkerefvgFITGSGGTTYYGESVKGrftisrdnaqnpvylqmnslkpedtavyycavYRRTYISSTYNESSEYDYwgqgtqvtvss
RANKLPMP9C12
evqlvesggglvqaggslrlscaasgrtfs--
RSAMGwfrqapgkerefvgFITGSGGTTYYGESVKGrftisrdnaqnpvylqmnslkpedtavyycgvYRRTYISSTYSESSEYDYwgqgtqvtvss

FAMILY 8

RANKLPMP1D8
evqlvesggglvqagdslrlscaasgrift-----
MGwfrqapgkerefvaAISGSGSITNYADSVKGrftisrdyakttvflqmnslkpedtavyycaaYVRTPYYSSYYDSTKYEYwgqgtqvtvss
RANKLPMP1A2
evqlvesggglvqagdslrlscaasgrtft-----
MGwfrqapgkerefvaFISGSGSVTNYTDSVKGrftisrdhakntvflqmnslkpedtavyycaaYLRGPYYSSFYDSTKYEYwgqgtqvtvss
RANKLPMP6C8 (RANKL19)
evqlvesggglvqagdslrlscaasgrtvt-----
MGwfrqapgkerefvaSITGSGSVTNYADSVKGrftisrdnakntvflqmnslkpedtavyycaaYLPSPYYSSYYDSTKYEYwgqgtqvtvss
RANKLPMP1E5
evqlvesggglvqagdslrlscaasgrtft-----
MGwfrrapgterefvaSISGSGKITNYADSVKGrftisrdhaknavflqmdglkpedtavyycaaYLRSPYYSSYYDSAKYEYwgqgtqvtvss
RANKLPMP2F4 (RANKL20)
evqlvesggglvqagdslrlscaasgrtft-----
MGwfrqapgterefvaAISGSGKITNYADSVKGrftisrdhakntvflqmdslkpedtavycagYLRSPYYSSFYDSAKYEYwgqgtqvtvss
RANKLPMP2B8
evqlvesgggsvqagdslrlscaasgrtft-----
MGwfrqapgterefvaAISGSGKITNYADSVKGrftisrdhamntvflqmdslkpedtavyycaaYLRSPYYSSYYDSAKYEYwgqgtqvtvss
RANKLPMP2C5
evqlvesggglvqagdslrlscaasgrtft-----
MGwfrqapgterefvaAISGSGKITNYADSVKGrftisrdhakntvflqmdslkpedtavyycaaYLRSPYYSSYYDSAKYEYwgqgtqvtvss
RANKLPMP2B4
evqlvesggglvqagdslrlscaasgrtft-----
MGwfrqapgterefvaAISGSGKITNYADSVKgrftisrdhakntvflqmdslkpedtavyycaaYLRSPYYSSYYDSAKYEYwgqgtqvtvss
RANKLPMP2A5
evqlvesggglvqagdslrlscaasgrtft-----
MGwfrqapgterefvaAISGSGKITNYADSVKGrftisrdhakntvflqmdslkpedtavyycaaYLRSPYYSSYYDSAKYEYwgqgtqvtvss
RANKLPMP2D7
evqlvesggglvqagdslrlscaasgrtft-----
MGwfrqapgterefvaAISGSGKITNYADSVKGrftisrdhakntvflqmdslkpedtavyycaaYLRSPYYSSYYDSAKYEYwgqgtqvtvss
RANKLPMP2G4
evqlvesggglvqagdslrlscaasgrtft-----
MGwfrqapgterefvaAISGSGKITNYADSVKGrftisrdhakntvflqmdslkpedtavyycaaYLRSPYYSSYYDSAKYEYwgqgtqvtvss

TABLE C-1-continued

Anti-RANK-L NANOBODY sequences obtained as described in Example 1. The Nanobody sequences are grouped by family. Unique sequences are indicated.

FAMILY 9

RANKLPMP7A8
emqlvesggglvqaggslrlscvaskrtfa--SYAMGwfrqvpgkerdfvaAISTH-
SITVYADSVKGrftisrdnakntvylqmntlkpedtavyycaaGNREPYLRQYlASNPYDYwgqgtqvtvss
RANKLPMP7C6 (RANKL21)
evqlvesggglvqaggslrlscvasrrtfn--SYAVGwfrqvpgeerdfvaAISTG-
SVTIYADSVKGrftisrdnakntvylqmnslkpedtavyycaaGNREPYLRQYTASNPYDYwgqgtqvtvss
RANKLPMP7A5
evqlvesggglvqtggslrlscvasrrtfs--SYAVGwfrqvpgkerdfvaAISTG-
SVTIYADSVKGrftisrdntkntvylqmnslkpedtavyycaaGNREPYLRQYTASNPYDYwgqgtqvtvss

TABLE C-2

ED50 values obtained with the anti-RANK-L NANOBODIES in ELISA

| NANOBODY | ED50 (pM) |
|---|---|
| RANKL1 | 619 |
| RANKL3 | 568 |
| RANKL4 | 380 |
| RANKL6 | 385 |
| RANKL7 | 376 |
| RANKL8 | 652 |
| RANKL9 | 542 |
| RANKL11 | 517 |
| RANKL12 | 399 |
| RANKL13 | 226 |
| RANKL14 | 574 |
| RANKL15 | 266 |
| RANKL16 | 953 |
| RANKL17 | 453 |
| RANKL18 | 242 |
| RANKL19 | 506 |
| RANKL20 | 306 |
| RANKL21 | 861 |
| RANKL22 | 379 |
| RANKL23 | 679 |

TABLE C-3

IC50 values obtained with the anti-RANK-L NANOBODIES in AlphaScreen assay

| NANOBODY | IC50 (pM) |
|---|---|
| RANKL1 | 739 |
| RANKL3 | 497 |
| RANKL4 | 582 |
| RANKL6 | 288 |
| RANKL7 | 459 |
| RANKL8 | 755 |
| RANKL9 | 137 |
| RANKL11 | 1170 |
| RANKL12 | 627 |
| RANKL13 | 185 |
| RANKL14 | 1750 |
| RANKL15 | 283 |
| RANKL16 | 2250 |
| RANKL17 | 737 |
| RANKL18 | 146 |
| RANKL19 | 2240 |
| RANKL20 | 1360 |
| RANKL21 | 1580 |
| RANKL22 | 3020 |
| RANKL23 | 3530 |

TABLE C-4

Dose-dependent binding of NANOBODIES to membrane-bound human and cyno RANK-L (PE mean fluorescence)

| Nanobody | human RANK-L | | | | | | cynomolgus RANK-L | | | |
|---|---|---|---|---|---|---|---|---|---|---|
| (pM) | RANKL6 | RANKL9 | RANKL13 | RANKL15 | RANKL18 | irrelevant | RANKL13 | RANKL15 | RANKL18 | irrelevant |
| 2000 | 12752 | 4865 | 13918 | 7724 | 7633 | 87 | 12442 | 10956 | 12032 | 149 |
| 400 | 4579 | 3365 | 5225 | 2641 | 2327 | 90 | 4107 | 3410 | 3488 | 140 |
| 80 | 1697 | 2279 | 1534 | 715 | 649 | 82 | | | | |
| 16 | 434 | 1350 | 499 | 250 | 218 | 77 | | | | |
| 3.2 | 347 | 381 | 220 | 124 | 105 | 84 | | | | |

TABLE C-5

Comparison of monovalent and trivalent bispecific anti-RANK-L NANOBODIES in AlphaScreen

| NANOBODY | IC50 (pM) |
|---|---|
| RANKL3 | 474 |
| RANKL6 | 777 |
| RANKL9 | 341 |

TABLE C-5-continued

Comparison of monovalent and trivalent bispecific anti-RANK-L NANOBODIES in AlphaScreen

| NANOBODY | IC50 (pM) |
|---|---|
| RANKL13 | 147 |
| RANKL15 | 572 |
| RANKL18 | 187 |
| RANKL30 | 44 |
| RANKL60 | 26 |
| RANKL90 | 68 |
| RANKL130 | 29 |
| RANKL150 | 92 |
| RANKL180 | 33 |

TABLE C-6

Comparison of monovalent and trivalent bispecific anti-RANK-L NANOBODIES in cell based competitive binding assay

| NANOBODY | IC50 (pM) |
|---|---|
| RANKL13 | 429 |
| RANKL15 | 534 |
| RANKL18 | 552 |
| RANKL130 | 55 |
| RANKL150 | 210 |
| RANKL180 | 106 |

TABLE C-7

Potency of anti-RANK-L NANOBODIES in NF-kappaB reporter gene assay

| Compound | IC50 (nM) |
|---|---|
| RANKL13 | 6.205 ± 3.019 (n = 2) |
| RANKL15 | 10.03 ± 2.390 (n = 2) |
| RANKL18 | 15.24 ± 1.923 (n = 2) |
| RANKL3 | 8.32 ± 3.747 (n = 2) |
| RANKL130 | 2.375 ± 2.379 (n = 2) |
| RANKL150 | 6.24 ± 4.765 (n = 2) |
| RANKL180 | 3.95 ± 0.183 (n = 2) |
| OPG | 6.03 (n = 1) |

TABLE C-9

Binding of RANKL NANOBODIES on human/mouse hybrids of RANK-L as described in Example 6.

| | RANK-L | | | |
|---|---|---|---|---|
| NANOBODY | hRANK-L | h/m hybrid 1 | h/m hybrid 2 | h/m hybrid 3 |
| RANKL3 | + | + | + | + |
| RANKL6 | + | + | − | + |
| RANKL9 | + | + | + | − |
| RANKL13 | + | + | − | − |
| RANKL15 | + | + | − | − |
| RANKL18 | + | + | + | − |
| MoAb[1] | + | + | + | + |

[1]Monoclonal antibody against human RANK-L (R&D Systems, Minneapolis, MN; Cat No. 6262).

TABLE C-10

Dosing of the animals in the pharmacokinetics and pharmacodynamics study as described in Example 7.

| Group | Animal ID | Dose and route of administration | Single/Repeated |
|---|---|---|---|
| RANKL130 | 1m | 10 mg/kg (IV bolus) | Single |
| | 2f | 10 mg/kg (IV bolus) | Single |
| RANKL131 | 3m | 15 mg/kg (infusion 8 hrs) | Single |
| | 4f | 15 mg/kg (infusion 8 hrs) | Single |
| RANKL180 | 5m | 10 mg/kg (IV bolus) | Single |
| | 6f | 10 mg/kg (IV bolus) | Single |
| ALB1 | 7m | 10 mg/kg (IV bolus) | Single |
| | 8f | 10 mg/kg (IV bolus) | Single |
| Ibandronate | 9m | 0.15 mg/kg (IV bolus) | Repeated (monthly) |
| | 10f | 0.15 mg/kg (IV bolus) | Repeated (monthly) |

TABLE C-8

Primers used for the construction of the human/mouse hybrids as described in Example 6.

| Name | Sequence 5' to 3' | SEQ ID NO |
|---|---|---|
| T7-EEV | AAGGCTAGAGTACTTAATACGA | 799 |
| RevpCIneo | CTTATCATGTCTGCTCGAAGC | 800 |
| RevhRANKLM1 | GGGAACCAGATGGGATGGAGGCGGCATTAATAGTGAGATGAG | 801 |
| FwhRANKLM1 | CTCATCTCACTATTAATGCCGCCTCCATCCCATCTGGTTCCC | 802 |
| RevhRANKLM2 | CCATTAGTTGAAGATACTCTGTAGCCACGCTTCCTGAAGTTTCATG | 803 |
| FwhRANKLM2 | CATGAAACTTCAGGAAGCGTGGCTACAGAGTATCTTCAACTAATGG | 804 |
| RevhRANKLM3 | CCATTAGTTGAAGATAGTCTGTAGGTAGGTCTCC | 805 |
| FwhRANKLM3 | GGAGACCTACCTACAGACTATCTTCAACTAATGG | 806 |

TABLE C-11

Values obtained for the pharmacokinetic parameters in the Cynomolgus Monkeys study as described in Example 7.

| Parameter[1] | cyno 1m | cyno 2f | cyno 5m | cyno 6f |
|---|---|---|---|---|
| $V_{ss\_pred}$ (mL/kg) | 67.7 | 71.1 | 67.1 | 55.4 |
| $CL_{pred}$ (mL/day/kg) | 7.71 | 7.91 | 5.86 | 5.08 |
| $MRT_{inf\_pred}$ (day) | 8.79 | 8.98 | 11.5 | 10.9 |
| $t_{1/2\ \lambda z1}$ (day)[2] | 6.75 | 6.81 | 8.74 | 9.28 |
| $\lambda_{z1\_lower}$-$\lambda_{z1\_upper}$ (day) | 1-39 | 2-51 | 4-51 | 1-32 |
| $R^2\ t_{1/2\ \lambda z1}$ | 0.992 | 0.998 | 0.993 | 0.982 |
| $t_{1/2\ \lambda z2}$ (day)[3] | 3.10 | 3.29 | 2.53 | 2.21 |
| $\lambda_{z2\_lower}$-$\lambda_{z2\_upper}$ (day) | 39-58 | 51-72 | 58-72 | 36-51 |
| $R^2\ t_{1/2\ \lambda z2}$ | 0.994 | 0.985 | 0.991 | 0.984 |
| $AUC_{0-39\ days}$ | 1287 | — | 1693 | — |
| $AUC_{0-51\ days}$ | — | 1260 | — | 1909 |
| $AUC_{last}$ (µg · day/mL) | 1297 | 1264 | 1707 | 1970 |
| % $AUC_{extrap\_pred}$ | 0.0117 | 0.0033 | 0.0046 | 0.0112 |
| $AUC_{inf\_pred}$ (µg · day/mL) | 1297 | 1264 | 1708 | 1970 |
| $AUC_{inf\_pred}$/D (kg · day/mL) | 0.130 | 0.126 | 0.171 | 0.197 |

[1] All parameters were calculated with non-compartmental modelling.
[2] Half-life calculated on apparent beta phase.
[3] Half-life calculated on apparent gamma phase.

TABLE C-12

Values obtained for the pharmacokinetic parameters in the Cynomolgus Monkeys study as described in Example 7.

| Parameter[1] | cyno 3m | cyno 4f |
|---|---|---|
| $V_{ss\_pred}$ (mL/kg) | 488 | 775 |
| $CL_{pred}$ (mL/day/kg) | 2433 | 3355 |
| $MRT_{inf\_pred}$ (day) | 0.200 | 0.231 |
| $t_{1/2\ \lambda z}$ (day) | 0.787 | 0.843 |
| $\lambda_{z1\_lower}$-$\lambda_{z1\_upper}$ (day) | 1.0-4.0 | 1.0-4.0 |
| $R^2\ t_{1/2\ \lambda z}$ | 0.970 | 0.918 |
| $AUC_{last}$ (µg · day/mL) | 6.14 | 4.45 |
| % $AUC_{extrap\_pred}$ | 0.380 | 0.493 |
| $AUC_{inf\_pred}$ (µg · day/mL) | 6.16 | 4.47 |
| $AUC_{inf\_pred}$/D (kg · day/mL) | 0.0004 | 0.0003 |

[1] All parameters calculated with non-compartmental modelling

TABLE C-13

Activity of the humanized RANKL NANOBODIES in AlphaScreen and Biacore 3000.

| | AlphaScreen | Biacore | | |
|---|---|---|---|---|
| NANOBODY | IC50 (pM) | Kd (s-1) | Ka (M-1s-1) | KD (M) |
| RANKL13 | 174 | 2.50E-04 | 5.00E+05 | 5.00E-10 |
| RANKL13basic | 159 | 1.89E-04 | 8.85E+05 | 2.14E-10 |
| RANKL13hum1 | 123 | 1.45E-04 | 1.37E+06 | 1.06E-10 |
| RANKL13hum2 | 191 | 2.32E-04 | 2.64E+05 | 8.80E-10 |
| RANKL13hum3 | 196 | 1.74E-04 | 6.59E+05 | 2.64E-10 |
| RANKL13hum4 | 223 | 2.04E-04 | 3.79E+05 | 5.38E-10 |
| RANKL13hum5 | 91 | 2.10E-04 | 8.00E+05 | 2.60E-10 |
| RANKL18 | 292 | 5.60E-05 | 3.10E+05 | 1.80E-10 |
| RANKL18basic | 219 | 1.00E-04 | 6.12E+05 | 1.63E-10 |
| RANKL18hum1 | 3153 | 2.36E-04 | 1.51E+05 | 1.56E-09 |
| RANKL18hum2 | 3186 | 1.73E-04 | 6.34E+04 | 2.73E-09 |
| RANKL18hum3 | 274 | 1.27E-04 | 4.41E+05 | 2.88E-10 |
| RANKL18hum4 | ND | ND | ND | ND |
| RANKL18hum5 | 253 | 9.94E-05 | 4.29E+05 | 2.32E-10 |
| RANKL18hum6 | 138 | 6.72E-05 | 5.00E+05 | 1.60E-10 |
| RANKL18hum7 | 572 | 2.70E-04 | 1.80E-05 | 1.50E-09 |

TABLE C-14

Activity of different NANOBODY constructs in AlphaScreen and FMAT.

| NANOBODY | AlphaScreen IC50(pM) | FMAT IC50(pM) |
|---|---|---|
| RANKL13 | 120 | 264 |
| RANKL130 | 31 | 45 |
| RANKL131 | 19 | 23 |
| RANKL133 | 26 | ND |
| RANKL18 | 253 | 253 |
| RANKL180 | 39 | 56 |
| RANKL181biv | 113 | 134 |
| RANKL182biv | 89 | 76 |
| RANKL183biv | 49 | 52 |
| RANKL18hum6Bi_25 | 100 | 38 |
| RANKL18hum6Bi_30 | 50 | 38 |
| RANKL9 | 238 | 130 |
| RANKL90 | 63 | 49 |
| RANKL91biv | 153 | 90 |
| RANKL92biv | 70 | 32 |
| RANKL93biv | 66 | 48 |
| RANKL94biv | 72 | 30 |

TABLE C-15

Different construct made of the humanized NANOBODIES.

| NANOBODY format | NANOBODY ID | SEQ ID NO |
|---|---|---|
| RANKL13hum5-ALB012-RANKL13hum5 | RANKL008a | 759 |
| RANKL18hum6-ALB012-RANKL18hum6 | RANKL010a | 760 |
| RANKL18hum6-9GS-RANKL13hum5-PEG | RANKL001p | 761 |
| RANKL18hum6-30GS-RANKL18hum6-PEG | RANKL003p | 762 |
| RANKL13hum5-9GS-RANKL13hum5-HSA | RANKL004h | 772 |
| RANKL18hum6-30GS-RANKL18hum6-HSA | RANKL006h | 773 |

TABLE C-16

Activity of the different constructs of the humanized NANOBODIES in AlphaScreen and FMAT.

| NANOBODY | AlphaScreen IC50 (pM) | FMAT IC50 (pM) |
|---|---|---|
| RANKL13hum5 | 188 | 137 |
| RANKL008a | 25 | 36 |

TABLE C-16-continued

Activity of the different constructs of the humanized NANOBODIES in AlphaScreen and FMAT.

| NANOBODY | AlphaScreen IC50 (pM) | FMAT IC50 (pM) |
|---|---|---|
| RANKL001p | 49 | 41 |
| RANKL004h | 48 | 34 |
| RANKL130 | 17 | 42 |
| RANKL18hum6 | 87 | 380 |
| RANKL3p | 25 | 38 |
| RANKL10a | 28 | 57 |
| RANKL180 | 30 | NA |

TABLE C-17

Basic pharmacokinetic parameters of NANOBODIES after a single intravenous administration (100 μg/animal) in the male Balb/c mouse.

| Parameter | RANKL008a Mean | SD | CV(%) | RANKL010a Mean | SD | CV(%) | RANKL001p Mean | SD | CV(%) | RANKL003p Mean | SD | CV(%) |
|---|---|---|---|---|---|---|---|---|---|---|---|---|
| C(0) (g/ml) | 87.2 | 8.2 | 9 | 80.8 | 25.5 | 32 | — | — | — | 122 | 61 | 50 |
| Vss (mL) | 2.03 | 0.05 | 2 | 2.73 | 0.72 | 26 | — | — | — | 1.32 | 0.61 | 46 |
| Vc (mL) | 1.16 | 0.11 | 9 | 1.35 | 0.52 | 39 | — | — | — | 1.08 | 0.77 | 71 |
| Vt (mL) | 0.870 | 0.158 | 18 | 1.38 | 0.21 | 15 | — | — | — | 0.250 | 0.159 | 64 |
| CL (mL/day) | 1.15 | 0.08 | 7 | 1.36 | 0.40 | 29 | — | — | — | 0.629 | 0.263 | 42 |
| CLd (mL/day) | 2.06 | 0.18 | 9 | 5.12 | 0.95 | 19 | — | — | — | 1.09 | 0.41 | 38 |
| t½alpha (hr) | 3.55 | 0.35 | 10 | 2.06 | 0.48 | 23 | — | — | — | 2.99 | 2.41 | 81 |
| t½beta (day) | 1.37 | 0.01 | 1 | 1.50 | 0.09 | 6 | — | — | — | 1.53 | 0.07 | 4 |
| MRT (day) | 1.77 | 0.08 | 4 | 2.02 | 0.10 | 5 | — | — | — | 2.08 | 0.09 | 4 |
| AUCinf (g"day/ml) | 87.4 | 6.2 | 7 | 77.1 | 19.1 | 25 | — | — | — | 176 | 60 | 34 |
| AUCinf/D (day/ml) | 0.874 | 0.062 | 7 | 0.771 | 0.191 | 25 | — | — | — | 1.76 | 0.60 | 34 |

TABLE C-18

Basic pharmacokinetic parameters of NANOBODIES after a single subcutaneous administration (100 μg/animal) in the male Balb/c mouse.

| Parameter | RANKL008a Mean | SD | CV(%) | RANKL010a Mean | SD | CV(%) | RANKL001p Mean | SD | CV(%) | RANKL003p Mean | SD | CV(%) |
|---|---|---|---|---|---|---|---|---|---|---|---|---|
| V/F (mL) | 2.59 | 0.34 | 13 | 2.39 | 0.10 | 4 | 4.53 | 4.68 | 103 | 1.01 | 0.29 | 29 |
| CL/F (mL/hr) | 1.41 | 0.19 | 13 | 1.12 | 0.01 | 1 | 1.93 | 2.03 | 105 | 0.447 | 0.109 | 24 |
| tlag (min) | — | — | — | — | — | — | 81.9 | 68.5 | 83 | — | — | — |
| t½ absorption (hr) | 20.4 | 6.8 | 33 | 13.6 | 0.4 | 3 | 7.8 | 1.5 | 19 | 12.2 | 2.8 | 23 |
| t½ elimination (day) | 1.27 | 0.04 | 3 | 1.49 | 0.06 | 4 | 1.65 | 0.04 | 2 | 1.55 | 0.08 | 5 |
| tmax (day) | 1.47 | 0.24 | 16 | 1.27 | 0.04 | 3 | 1.00 | 0.09 | 9 | 1.21 | 0.14 | 12 |
| Cmax (μg/ml) | 17.5 | 1.5 | 9 | 23.1 | 0.7 | 3 | 27.1 | 18.0 | 66 | 60.6 | 14.3 | 24 |
| AUCinf (μg · hr/ml) | 72.0 | 9.4 | 13 | 89.7 | 0.9 | 1 | 95.8 | 62.8 | 66 | 233 | 59 | 25 |
| AUCinf/D (hr/ml) | 0.720 | 0.094 | 13 | 0.897 | 0.009 | 1 | 0.958 | 0.628 | 66 | 2.33 | 0.59 | 25 |
| F (%) | 82.4 | | | 102 | | | — | | | 110-133 | | |

TABLE C-19

Dose, route and frequency of administration used in animal model as described in Example 14.

| Group | Test Item | Dose Level | Route/frequency admin. | Animal numbers |
|---|---|---|---|---|
| 1 | RANKL008a | 3.0 | IV/Once | 1-3 |
| 2 | RANKL008a | 0.3 | IV/Once | 4-6 |
| 3 | RANKL008a | 0.03 | IV/Once | 7-9 |
| 4 | RANKL008a | 3.0 | SC/Once | 10-12 |
| 5 | RANKL001p | 3.0 | IV/Once | 13-15 |
| 6 | RANKL001p | 0.3 | IV/Once | 16-18 |
| 7 | RANKL001p | 0.03 | IV/Once | 19-21 |
| 8 | RANKL001p | 3.0 | SC/Once | 22-24 |
| 9 | RANKL003p | 3.0 | IV/Once | 25-27 |
| 10 | RANKL003p | 0.3 | IV/Once | 28-30 |
| 11 | RANKL003p | 0.03 | IV/Once | 31-33 |
| 12 | RANKL003p | 3.0 | SC/Once | 34-36 |
| 13 | RANKL130 | 10 | IV/Once | 37-39 |
| 14 | RANKL130 | 3.0 | IV/Once | 40-42 |
| 15 | Ibandronate | 0.15 | IV/Every Month | 43-45 |
| 16 | ALB8 | 3.0 | IV/Once | 46-48 |
| 17 | PBS | | IV/Once | 49-51 |

TABLE C-20

Basic pharmacokinetic parameters of RANKL008a after a single intravenous bolus administration in the female cynomolgus monkey as described in Example 14.

| parameter | 3 mg/kg Mean | 3 mg/kg SD | 0.3 mg/kg Mean | 0.3 mg/kg SD | 0.03 mg/kg Mean | 0.03 mg/kg SD |
|---|---|---|---|---|---|---|
| Vss_pred (mL/kg) | 65.8 | 4.3 | 74.2 | 12.8 | 85.3 | 7.9 |
| CL_pred (mL/day/kg) | 8.33 | 1.71 | 14.0 | 0.6 | 50.8 | 11.0 |
| MRTinf_pred (day) | 8.07 | 1.37 | 5.29 | 0.68 | 1.72 | 0.31 |
| t½ λz1 (day)[1] | 7.28 | 0.07 | 5.83 | 0.27 | — | — |
| λz1_lower (day) | — | — | — | — | — | — |
| λz1_upper (day) | — | — | — | — | — | — |
| R2 t½ λz1 | — | — | — | — | — | — |
| t½ λz2 (day)[2] | 1.65 | 1.42 | 1.28 | 0.58 | 1.18 | 0.20 |
| λz2_lower (day) | — | — | — | — | — | — |
| λz2_upper (day) | — | — | — | — | — | — |
| R2 t½ λz2 | — | — | — | — | — | — |
| AUClast (mg · day/ml) | 370 | 74 | 19.5 | 3.0 | 0.546 | 0.186 |
| % AUCextrap_pred | 0.0510 | 0.0584 | 2.10 | 3.26 | 11.7 | 14.2 |
| AUCinf_pred (mg · day/ml) | 370 | 74 | 20.0 | 3.4 | 0.609 | 0.140 |
| AUCinf_pred/D (kg · day/ml) | 0.124 | 0.025 | 0.0716 | 0.0034 | 0.0203 | 0.0047 |

[1]Half-life calculated on apparent beta phase
[2]Half-life calculated on apparent gamma phase

TABLE C-21

Basic pharmacokinetic parameters of RANKL001p after a single intravenous bolus administration in the female cynomolgus monkey as described in Example 14.

| parameter | 3 mg/kg Mean | 3 mg/kg SD | 0.3 mg/kg Mean | 0.3 mg/kg SD | 0.03 mg/kg Mean | 0.03 mg/kg SD |
|---|---|---|---|---|---|---|
| Vss_pred (mL/kg) | 60.4 | 4.6 | 73.3 | 4.3 | 67.5 | 0.9 |
| CL_pred (mL/day/kg) | 8.69 | 0.82 | 15.0 | 1.5 | 41.3 | 4.5 |
| MRTinf_pred (day) | 6.95 | 0.13 | 4.90 | 0.51 | 1.64 | 0.18 |
| t½ λz1 (day)[1] | 5.14 | 0.15 | 4.11 | 0.44 | — | — |
| λz1_lower (day) | — | — | — | — | — | — |
| λz1_upper (day) | — | — | — | — | — | — |
| R2 t½ λz1 | — | — | — | — | — | — |
| t½ λz2 (day)[2] | 1.28 | 0.63 | 1.95 | 0.39 | 1.11 | 0.09 |
| λz2_lower (day) | — | — | — | — | — | — |
| λz2_upper (day) | — | — | — | — | — | — |
| R2 t½ λz2 | — | — | — | — | — | — |
| AUClast (mg · day/ml) | 346 | 31 | 19.7 | 2.0 | 0.670 | 0.095 |
| % AUCextrap_pred | 0.0191 | 0.0072 | 1.65 | 1.18 | 3.95 | 1.97 |
| AUCinf_pred (mg · day/ml) | 346 | 31 | 20.0 | 1.9 | 0.697 | 0.092 |
| AUCinf_pred/D (kg · day/ml) | 0.115 | 0.010 | 0.0669 | 0.0065 | 0.0244 | 0.0026 |

[1]Half-life calculated on apparent beta phase
[2]Half-life calculated on apparent gamma phase

TABLE C-22

Basic pharmacokinetic parameters of RANKL003p after a single intravenous bolus administration in the female cynomolgus monkey as described in Example 14.

| parameter | 3 mg/kg Mean | 3 mg/kg SD | 0.3 mg/kg Mean | 0.3 mg/kg SD | 0.03 mg/kg Mean | 0.03 mg/kg SD |
|---|---|---|---|---|---|---|
| Vss_pred (mL/kg) | 33.1 | 1.8 | 31.1 | 3.9 | 32.5 | 5.9 |
| CL_pred (mL/day/kg) | 4.49 | 0.04 | 5.93 | 0.60 | 14.9 | 2.9 |
| MRTinf_pred (day) | 7.38 | 0.34 | 5.25 | 0.50 | 2.21 | 0.37 |
| t½ λz1 (day)[1] | 5.75 | 1.10 | 4.57 | 0.24 | — | — |
| λz1_lower (day) | — | — | — | — | — | — |
| λz1_upper (day) | — | — | — | — | — | — |
| R2 t½ λz1 | — | — | — | — | — | — |
| t½ λz2 (day)[2] | 1.39 | 0.12 | 2.06 | 0.37 | 1.52 | 0.24 |

TABLE C-22-continued

Basic pharmacokinetic parameters of RANKL003p after a single intravenous bolus administration in the female cynomolgus monkey as described in Example 14.

| parameter | 3 mg/kg Mean | SD | 0.3 mg/kg Mean | SD | 0.03 mg/kg Mean | SD |
|---|---|---|---|---|---|---|
| λz2_lower (day) | — | — | — | — | — | — |
| λz2_upper (day) | — | — | — | — | — | — |
| R2 t½ λz2 | — | — | — | — | — | — |
| AUClast (mg · day/ml) | 647 | 32 | 50.2 | 4.9 | 1.88 | 0.42 |
| % AUCextrap_pred | 3.21 | 5.50 | 1.37 | 0.19 | 9.19 | 2.03 |
| AUCinf_pred (mg · day/ml) | 669 | 5 | 50.9 | 4.9 | 2.06 | 0.42 |
| AUCinf_pred/D (kg · day/ml) | 0.223 | 0.002 | 0.170 | 0.016 | 0.0688 | 0.0140 |

[1]Half-life calculated on apparent beta phase
[2]Half-life calculated on apparent gamma phase

TABLE C-23

Basic pharmacokinetic parameters of NANOBODIES after subcutaneous administration in the female cynomolgus monkeys as described in Example 14.

| parameter | RANKL008a Mean | SD | RANKL001p Mean | SD | RANKL003p Mean | SD |
|---|---|---|---|---|---|---|
| Vss/F (mL/g)[1] | 109 | 11 | 100 | 8 | 46.1 | 12.4 |
| CL/F_pred (mL/day/kg) | 7.93 | 0.70 | 11.7 | 0.2 | 6.66 | 0.65 |
| MRTinf_pred (day)[1] | 13.8 | 2.4 | 8.56 | 0.78 | 7.08 | 2.66 |
| t½ λz1 (day)[2] | 10.9 | 2.1 | 5.81 | 0.28 | 5.25 | 0.23 |
| λz1_lower (day) | — | — | — | — | — | — |
| λz1_upper (day) | — | — | — | — | — | — |
| R2 t½ λz1 | — | — | — | — | — | — |
| t½ λz2 (day)[3] | 2.07 | 0.99 | 1.86 | 0.28 | 1.03 | 0.37 |
| λz2_lower (day) | — | — | — | — | — | — |
| λz2_upper (day) | — | — | — | — | — | — |
| R2 t½ λz2 | — | — | — | — | — | — |
| AUClast (mg · day/ml) | 380 | 32 | 256 | 4 | 452 | 48 |
| % AUCextrap_pred | 0.005 | 0.002 | 0.104 | 0.074 | 0.382 | 0.562 |
| AUCinf_pred (mg · day/ml) | 380 | 32 | 256 | 3 | 453 | 46.7 |
| tmax (day) | 2.00 | 0.00 | 2.00 | 0.00 | 3.00 | 2.65 |
| Cmax (µg/ml) | 21.8 | 1.7 | 24.6 | 0.5 | 46.2 | 11.0 |
| AUCinf_pred/D (kg · day/ml) | 0.127 | 0.011 | 0.085 | 0.001 | 0.151 | 0.016 |
| F (%) | 103%[4] | | 74.0%[4] | | 67.7%[4] | |

[1]MRT calculated as AUMC/AUC and therefore not corrected for MAT. Vss/F = MRT•CL
[2]Half-life calculated on apparent b phase
[3]Half-life calculated on apparent g phase
[4]Estimation of F on the 3 mg/kg dose level ignoring immunogenity and non-linearity in CL

TABLE C-24

Pharmacodynamic parameters (±SE) of RANK008a, RANKL001p and RANKL003p in the female cynomolgus monkey as described in Example 14.

| Parameter | RANKL008a | RANKL001p | RANKL003p |
|---|---|---|---|
| $K_{in}$ (nM/day) | 938 ± 194 | 1201 ± 235 | 2835 ± 2758[1] |
| $K_{out}$ (1/day) | 8.99 ± 1.79 | 11.7 ± 2.1 | 25.9 ± 19.8[1] |
| $I_{max}$ | 0.878 ± 0.024 | 0.882 ± 0.017 | 0.892 ± 0.038 |
| $IC_{50}$ (µg/mL) | 0.049 ± 0.008 | 0.114 ± 0.025 | 0.518 ± 0.125 |
| n | 1.38 ± 0.29 | 1.23 ± 0.21 | 0.817 ± 0.182 |

[1]Values could not be estimated with sufficient precision

TABLE C-25

Main pharmacokinetic parameters (mean +/− SD; n = 3) of RANKL008a and αOPGL-1 following an single i.v. bolus administration with RANKL008a at 0.3 mg/kg or αOPGL-1 at 1 mg/kg in the female Cynomolgus monkey.

| Compound | RANKL008a | αOPGL-1 |
|---|---|---|
| Dose (mg/kg) | 0.3 mg/kg | 1 mg/kg |
| Route | IV | IV |
| N | n = 3 | n = 2 |
| C0 (ug/ml) | 3.47 | 14.7 |
| AUCinf (ug · d/ml) | 22.8 | 94.5 |
| t½ (d) | 8 | 6.5 |
| Cl (ml/d/kg) | 13.2 | 10.6 |
| Vss (ml/kg) | 77.1 | 72.8 |

TABLE C-26

Main average pharmacodynamic parameters (mean) of RANKL008a and αOPGL-1 following a single s.c. administration at 0.3 mg/kg (RANKL008a) or 1 mg/kg (αOPGL-1), respectively in the female Cynomolgus monkey.

| Compound | RANKL008a | αOPGL-1 |
|---|---|---|
| Dose (mg/kg) | 0.3 | 1 |
| Route | IV | IV |
| N | 3 | 2 |
| Tmin (d) | 8 | 11 |
| Rmin (%) | 9 | 14 |
| AUC below T (%*d) | 289 | 212 |
| Time below T (d) | 19 | 17.1 |
| T onset (d) | 0.143 | 0.125 |
| T offset (d) | 19.2 | 17.2 |

The terms and expressions which have been employed are used as terms of description and not of limitation, and there is no intention in the use of such terms and expressions of excluding any equivalents of the features shown and described or portions thereof, it being recognized that various modifications are possible within the scope of the invention.

All references disclosed herein are incorporated by reference, in particular for the teaching that is referenced hereinabove.

SEQUENCE LISTING (850 sequences)

SEQ ID NO: 1 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCAASGIPFSXXXXXWFRQAPGKQRDSVAXXXXXRFTISRDNAKNTVYLQMNSLKPEDTAVYRCYFXXXXXWGQGTQVTVSS

SEQ ID NO: 2 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVKLEESGGGLVQAGGSLRLSCVGSGRTFSXXXXXWFRLAPGKEREFVAXXXXXRFTISRDTASNRGYLHMNNLTPEDTAVYYCAAXXXXXWGQGTQVTVSS

SEQ ID NO: 3 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVDSGGGLVQAGDSLKLSCALTGGAFTXXXXXWFRQTPGREREFVAXXXXXRFTISRDNAKNMVYLRMNSLIPEDAAVYSCAAXXXXXWGQGTLVTVSS

SEQ ID NO: 4 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVEAGGSLRLSCTASESPFRXXXXXWFRQTSGQEREFVAXXXXXRFTISRDDAKNTVWLHGSTLKPEDTAVYYCAAXXXXXWGQGTQVTVSS

SEQ ID NO: 5 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQGGGSLRLACAASERIFDXXXXXWYRQGPGNERELVAXXXXXRFTISMDYTKQTVYLHMNSLRPEDTGLYYCKIXXXXXWGQGTQVTVSS

SEQ ID NO: 6 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
DVKFVESGGGLVQAGGSLRLSCVASGFNFDXXXXXWFRQAPGKEREEVAXXXXXRFTISSEKDKNSVYLQMNSLKPEDTALYICAGXXXXXWGRGTQVTVSS

SEQ ID NO: 7 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVRLAESGGGLVQSGGSLRLSCVASGSTYTXXXXXWYRQYPGKQRALVAXXXXXRFTIARDSTKDTFCLQMNNLKPEDTAVYYCYAXXXXXWGQGTQVTVSS

SEQ ID NO: 8 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGGSLRLSCAASGFTSDXXXXXWFRQAPGKPREGVSXXXXXRFTISTDNAKNTVHLLMNRVNAEDTALYYCAVXXXXXWGRGTRVTVSS

SEQ ID NO: 9 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCQASGDISTXXXXXWYRQVPGKLREFVAXXXXXRFTISGDNAKRAIYLQMNNLKPDDTAVYYCNRXXXXXWGQGTQVTVSP

SEQ ID NO: 10 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVPVVESGGGLVQAGDSLRLFCAVPSFTSTXXXXXWFRQAPGKEREFVAXXXXXRFTISRNATKNTLTLRMDSLKPEDTAVYYCAAXXXXXWGQGTQVTVSS

SEQ ID NO: 11 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQAGDSLRLFCTVSGGTASXXXXXWFRQAPGEKREFVAXXXXXRFTIARENAGNMVYLQMNNLKPDDTALYTCAAXXXXXWGRGTQVTVSS

SEQ ID NO: 12 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGDSVQPGDSQTLSCAASGRTNSXXXXXWFRQAPGKERVFLAXXXXXRFTISRDSAKNMMYLQMNNLKPQDTAVYYCAAXXXXXWGQGTQVTVSS

SEQ ID NO: 13 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCVVSGLTSSXXXXXWFRQTPWQERDFVAXXXXXRFTISRDNYKDTVLLEMNFLKPEDTAIYYCAAXXXXXWGQGTQVTVSS

SEQ ID NO: 14 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGASLRLSCATSTRTLDXXXXXWFRQAPGRDREFVAXXXXXRFTVSRDSAENTVALQMNSLKPEDTAVYYCAAXXXXXWGQGTRVTVSS

SEQ ID NO: 15 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
QVQLVESGGGLVQPGGSLRLSCTVSRLTAHXXXXXWFRQAPGKEREAVSXXXXXRFTISRDYAGNTAFLQMDSLKPEDTGVYYCATXXXXXWGQGTQVTVSS

SEQ ID NO: 16 - protein, 102 aa, Artificial
  KERE-class Nanobody
  misc_feature (31)..(35): Xaa is any amino acid
  misc_feature (50)..(54): Xaa is any amino acid
  misc_feature (87)..(91): Xaa is any amino acid
EVQLVESGGELVQAGGSLKLSCTASGRNFVXXXXXWFRRAPGKEREFVAXXXXXRFTVSRDNGKNTAYLRMNSLKPEDTADYYCAVXXXXXLGSGTQVTVSS

SEQ ID NO: 17 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQPGGSLRLSCAASGFTFSXXXXXWVRQAPGKVLEWVSXXXXXRFTISRDNAKNTLYLQMNSLKPEDTAVYYCVKXXXXXGSQGTQVTVSS

SEQ ID NO: 18 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLVQPGGSLRLSCVCVSSGCTXXXXXWVRQAPGKAEEWVSXXXXXRFKISRDNAKKTLYLQMNSLGPEDTAMYYCQRXXXXXRGQGTQVTVSS

SEQ ID NO: 19 - protein, 102 aa, Artificial
  GLEW-class Nanobody
  misc_feature (31)..(35): Xaa is any amino acid
  misc_feature (50)..(54): Xaa is any amino acid
  misc_feature (87)..(91): Xaa is any amino acid
EVQLVESGGGLALPGGSLTLSCVFSGSTFSXXXXXWVRHTPGKAEEWVSXXXXXRFTISRDNAKNTLYLEMNSLSPEDTAMYYCGRXXXXXRSKGIQVTVSS

SEQ ID NO: 20 - protein, 102 aa, Artificial
  P,R,S 103-class Nanobody
  misc_feature (31)..(35): Xaa is any amino acid
  misc_feature (50)..(54): Xaa is any amino acid
  misc_feature (87)..(91): Xaa is any amino acid
AVQLVESGGGLVQAGGSLRLSCAASGRTFSXXXXXWFRQAPGKEREFVAXXXXXRFTISRDNAKNTVYLQMNSLKPEDTAVYYCAAXXXXXRGQGTQVTVSS

SEQ ID NO: 21 - protein, 102 aa, Artificial
  P,R,S 103-class Nanobody
  misc_feature (31)..(35): Xaa is any amino acid
  misc_feature (50)..(54): Xaa is any amino acid
  misc_feature (87)..(91): Xaa is any amino acid
DVQLVESGGDLVQPGGSLRLSCAASGFSFDXXXXXWLRQTPGKGLEWVGXXXXXRFTISRDNAKNMLYLHLNNLKSEDTAVYYCRRXXXXXLGQGTQVTVSS

SEQ ID NO: 22 - protein, 102 aa, Artificial; identical to SEQ ID NO: 18
  P,R,S 103-class Nanobody
  misc_feature (31)..(35): Xaa is any amino acid
  misc_feature (50)..(54): Xaa is any amino acid
  misc_feature (87)..(91): Xaa is any amino acid

SEQ ID NO: 23 - protein, 30 aa, Artificial
  KERE-class Nanobody FW1 sequence
QVQRVESGGGLVQAGGSLRLSCAASGRTSS

SEQ ID NO: 24 - protein, 30 aa, Artificial
  KERE-class Nanobody FW1 sequence
QVQLVESGGGLVQTGDSLSLSCSASGRTFS

SEQ ID NO: 25 - protein, 30 aa, Artificial
  KERE-class Nanobody FW1 sequence
QVKLEESGGGLVQAGDSLRLSCAATGRAFG

SEQ ID NO: 26 - protein, 30 aa, Artificial
  KERE-class Nanobody FW1 sequence
AVQLVESGGGLVQPGESLGLSCVASGRDFV

SEQ ID NO: 27 - protein, 30 aa, Artificial
  KERE-class Nanobody FW1 sequence
EVQLVESGGGLVQAGGSLRLSCEVLGRTAG

SEQ ID NO: 28 - protein, 30 aa, Artificial
  KERE-class Nanobody FW1 sequence
QVQLVESGGGWVQPGGSLRLSCAASETILS

SEQ ID NO: 29 - protein, 30 aa, Artificial
  KERE-class Nanobody FW1 sequence
QVQLVESGGGTVQPGGSLNLSCVASGNTFN

SEQ ID NO: 30 - protein, 30 aa, Artificial
  KERE-class Nanobody FW1 sequence
EVQLVESGGGLAQPGGSLQLSCSAPGFTLD

SEQ ID NO: 31 - protein, 30 aa, Artificial
  KERE-class Nanobody FW1 sequence
AQELEESGGGLVQAGGSLRLSCAASGRTFN

SEQ ID NO: 32 - protein, 22 aa, Artificial
  KERE-class Nanobody FW1 sequence
VESGGGLVQPGGSLRLSCAASG

SEQ ID NO: 33 - protein, 22 aa, Artificial
  KERE-class Nanobody FW1 sequence
VDSGGGLVQAGDSLKLSCALTG

SEQ ID NO: 34 - protein, 22 aa, Artificial
  KERE-class Nanobody FW1 sequence
VDSGGGLVQAGDSLRLSCAASG

SEQ ID NO: 35 - protein, 22 aa, Artificial
  KERE-class Nanobody FW1 sequence
VDSGGGLVEAGGSLRLSCQVSE

SEQ ID NO: 36 - protein, 22 aa, Artificial
  KERE-class Nanobody FW1 sequence
QDSGGGSVQAGGSLKLSCAASG

SEQ ID NO: 37 - protein, 22 aa, Artificial
  KERE-class Nanobody FW1 sequence
VQSGGRLVQAGDSLRLSCAASE

SEQ ID NO: 38 - protein, 22 aa, Artificial
  KERE-class Nanobody FW1 sequence
VESGGTLVQSGDSLKLSCASST

SEQ ID NO: 39 - protein, 22 aa, Artificial
  KERE-class Nanobody FW1 sequence
MESGGDSVQSGGSLTLSCVASG

SEQ ID NO: 40 - protein, 22 aa, Artificial
  KERE-class Nanobody FW1 sequence
QASGGGLVQAGGSLRLSCSASV

SEQ ID NO: 41 - protein, 14 aa, Artificial
  KERE-class Nanobody FW2 sequence
WFRQAPGKEREFVA

SEQ ID NO: 42 - protein, 14 aa, Artificial
  KERE-class Nanobody FW2 sequence
WFRQTPGREREFVA

SEQ ID NO: 43 - protein, 14 aa, Artificial
  KERE-class Nanobody FW2 sequence
WYRQAPGKQREMVA

SEQ ID NO: 44 - protein, 14 aa, Artificial
  KERE-class Nanobody FW2 sequence
WYRQGPGKQRELVA

SEQ ID NO: 45 - protein, 14 aa, Artificial
  KERE-class Nanobody FW2 sequence
WIRQAPGKEREGVS

SEQ ID NO: 46 - protein, 14 aa, Artificial
  KERE-class Nanobody FW2 sequence
WFREAPGKEREGIS

SEQ ID NO: 47 - protein, 14 aa, Artificial
  KERE-class Nanobody FW2 sequence
WYRQAPGKERDLVA

SEQ ID NO: 48 - protein, 14 aa, Artificial
  KERE-class Nanobody FW2 sequence
WFRQAPGKQREEVS

SEQ ID NO: 49 - protein, 14 aa, Artificial
  KERE-class Nanobody FW2 sequence
WFRQPPGKVREFVG

SEQ ID NO: 50 - protein, 32 aa, Artificial
  KERE-class Nanobody FW3 sequence
RFTISRDNAKNTVYLQMNSLKPEDTAVYRCYF

SEQ ID NO: 51 - protein, 32 aa, Artificial
  KERE-class Nanobody FW3 sequence
RFAISRDNNKNTGYLQMNSLEPEDTAVYYCAA

SEQ ID NO: 52 - protein, 32 aa, Artificial
  KERE-class Nanobody FW3 sequence
RFTVARNNAKNTVNLEMNSLKPEDTAVYYCAA

SEQ ID NO: 53 - protein, 32 aa, Artificial
  KERE-class Nanobody FW3 sequence
RFTISRDIAKNTVDLLMNNLEPEDTAVYYCAA

SEQ ID NO: 54 - protein, 32 aa, Artificial
  KERE-class Nanobody FW3 sequence
RLTISRDNAVDTMYLQMNSLKPEDTAVYYCAA

SEQ ID NO: 55 - protein, 32 aa, Artificial
  KERE-class Nanobody FW3 sequence
RFTISRDNAKNTVYLQMDNVKPEDTAIYYCAA

SEQ ID NO: 56 - protein, 32 aa, Artificial
  KERE-class Nanobody FW3 sequence
RFTISKDSGKNTVYLQMTSLKPEDTAVYYCAT

SEQ ID NO: 57 - protein, 32 aa, Artificial
  KERE-class Nanobody FW3 sequence
RFTISRDSAKNMMYLQMNNLKPQDTAVYYCAA

SEQ ID NO: 58 - protein, 32 aa, Artificial
  KERE-class Nanobody FW3 sequence
RFTISRENDKSTVYLQLNSLKPEDTAVYYCAA

SEQ ID NO: 59 - protein, 32 aa, Artificial
  KERE-class Nanobody FW3 sequence
RFTISRDYAGNTAYLQMNSLKPEDTGVYYCAT

SEQ ID NO: 60 - protein, 11 aa, Artificial
  KERE-class Nanobody FW4 sequence
WGQGTQVTVSS

SEQ ID NO: 61 - protein, 11 aa, Artificial
  KERE-class Nanobody FW4 sequence
WGKGTLVTVSS

SEQ ID NO: 62 - protein, 11 aa, Artificial
  KERE-class Nanobody FW4 sequence
RGQGTRVTVSS

SEQ ID NO: 63 - protein, 11 aa, Artificial
  KERE-class Nanobody FW4 sequence
WGLGTQVTISS

SEQ ID NO: 64 - protein, 30 aa, Artificial
  GLEW-class Nanobody FW1 sequence
QVQLVESGGGLVQPGGSLRLSCAASGFTFS

SEQ ID NO: 65 - protein, 30 aa, Artificial
  GLEW-class Nanobody FW1 sequence
EVHLVESGGGLVRPGGSLRLSCAAFGFIFK

SEQ ID NO: 66 - protein, 30 aa, Artificial
  GLEW-class Nanobody FW1 sequence
QVKLEESGGGLAQPGGSLRLSCVASGFTFS

SEQ ID NO: 67 - protein, 30 aa, Artificial
  GLEW-class Nanobody FW1 sequence
EVQLVESGGGLVQPGGSLRLSCVCVSSGCT

SEQ ID NO: 68 - protein, 30 aa, Artificial
  GLEW-class Nanobody FW1 sequence
EVQLVESGGGLALPGGSLTLSCVFSGSTFS

SEQ ID NO: 69 - protein, 22 aa, Artificial
  GLEW-class Nanobody FW1 sequence
VESGGGLVQPGGSLRLSCAASG

SEQ ID NO: 70 - protein, 22 aa, Artificial
  GLEW-class Nanobody FW1 sequence
EESGGGLAQPGGSLRLSCVASG

SEQ ID NO: 71 - protein, 22 aa, Artificial
  GLEW-class Nanobody FW1 sequence
VESGGGLALPGGSLTLSCVFSG

SEQ ID NO: 72 - protein, 14 aa, Artificial
  GLEW-class Nanobody FW2 sequence
WVRQAPGKVLEWVS

SEQ ID NO: 73 - protein, 14 aa, Artificial
  GLEW-class Nanobody FW2 sequence
WVRRPPGKGLEWVS

SEQ ID NO: 74 - protein, 14 aa, Artificial
  GLEW-class Nanobody FW2 sequence
WVRQAPGMGLEWVS

SEQ ID NO: 75 - protein, 14 aa, Artificial
  GLEW-class Nanobody FW2 sequence
WVRQAPGKEPEWVS

SEQ ID NO: 76 - protein, 14 aa, Artificial
  GLEW-class Nanobody FW2 sequence
WVRQAPGKDQEWVS

SEQ ID NO: 77 - protein, 14 aa, Artificial
  GLEW-class Nanobody FW2 sequence
WVRQAPGKAEEWVS

SEQ ID NO: 78 - protein, 14 aa, Artificial
  GLEW-class Nanobody FW2 sequence
WVRQAPGKGLEWVA

SEQ ID NO: 79 - protein, 14 aa, Artificial
  GLEW-class Nanobody FW2 sequence
WVRQAPGRATEWVS

SEQ ID NO: 80 - protein, 32 aa, Artificial
  GLEW-class Nanobody FW3 sequence
RFTISRDNAKNTLYLQMNSLKPEDTAVYYCVK

SEQ ID NO: 81 - protein, 32 aa, Artificial
  GLEW-class Nanobody FW3 sequence
RFTISRDNARNTLYLQMDSLIPEDTALYYCAR

SEQ ID NO: 82 - protein, 32 aa, Artificial
  GLEW-class Nanobody FW3 sequence
RFTSSRDNAKSTLYLQMNDLKPEDTALYYCAR

SEQ ID NO: 83 - protein, 32 aa, Artificial
  GLEW-class Nanobody FW3 sequence
RFIISRDNAKNTLYLQMNSLGPEDTAMYYCQR

SEQ ID NO: 84 - protein, 32 aa, Artificial
  GLEW-class Nanobody FW3 sequence
RFTASRDNAKNTLYLQMNSLKSEDTARYYCAR

SEQ ID NO: 85 - protein, 32 aa, Artificial
  GLEW-class Nanobody FW3 sequence
RFTISRDNAKNTLYLQMDDLQSEDTAMYYCGR

SEQ ID NO: 86 - protein, 11 aa, Artificial
  GLEW-class Nanobody FW4 sequence
GSQGTQVTVSS

SEQ ID NO: 87 - protein, 11 aa, Artificial
  GLEW-class Nanobody FW4 sequence
LRGGTQVTVSS

SEQ ID NO: 88 - protein, 11 aa, Artificial
  GLEW-class Nanobody FW4 sequence
RGQGTLVTVSS

SEQ ID NO: 89 - protein, 11 aa, Artificial
  GLEW-class Nanobody FW4 sequence
RSRGIQVTVSS

SEQ ID NO: 90 - protein, 11 aa, Artificial
  GLEW-class Nanobody FW4 sequence
WGKGTQVTVSS

SEQ ID NO: 91 - protein, 11 aa, Artificial
  GLEW-class Nanobody FW4 sequence
WGQGTQVTVSS

SEQ ID NO: 92 - protein, 30 aa, Artificial
  P,R,S 103-class Nanobody FW1 sequence
AVQLVESGGGLVQAGGSLRLSCAASGRTFS

SEQ ID NO: 93 - protein, 30 aa, Artificial
  P,R,S 103-class Nanobody FW1 sequence
QVQLQESGGGMVQPGGSLRLSCAASGFDFG

SEQ ID NO: 94 - protein, 30 aa, Artificial; identical to SEQ ID NO: 65
  P,R,S 103-class Nanobody FW1 sequence

SEQ ID NO: 95 - protein, 30 aa, Artificial
  P,R,S 103-class Nanobody FW1 sequence
QVQLAESGGGLVQPGGSLKLSCAASRTIVS

SEQ ID NO: 96 - protein, 30 aa, Artificial
  P,R,S 103-class Nanobody FW1 sequence
QEHLVESGGGLVDIGGSLRLSCAASERIFS

SEQ ID NO: 97 - protein, 30 aa, Artificial; identical to SEQ ID NO: 66
  P,R,S 103-class Nanobody FW1 sequence

SEQ ID NO: 98 - protein, 30 aa, Artificial; identical to SEQ ID NO: 67
  P,R,S 103-class Nanobody FW1 sequence

SEQ ID NO: 99 - protein, 30 aa, Artificial; identical to SEQ ID NO: 68
  P,R,S 103-class Nanobody FW1 sequence

SEQ ID NO: 100 - protein, 22 aa, Artificial
  P,R,S 103-class Nanobody FW1 sequence
VESGGGLVQAGGSLRLSCAASG

SEQ ID NO: 101 - protein, 22 aa, Artificial
  P,R,S 103-class Nanobody FW1 sequence
AESGGGLVQPGGSLKLSCAASR

SEQ ID NO: 102 - protein, 14 aa, Artificial
  P,R,S 103-class Nanobody FW2 sequence
WFRQAPGKEREFVA

SEQ ID NO: 103 - protein, 14 aa, Artificial
  P,R,S 103-class Nanobody FW2 sequence
WVRQAPGKVLEWVS

SEQ ID NO: 104 - protein, 14 aa, Artificial
  P,R,S 103-class Nanobody FW2 sequence
WVRRPPGKGLEWVS

SEQ ID NO: 105 - protein, 14 aa, Artificial
  P,R,S 103-class Nanobody FW2 sequence
WIRQAPGKEREGVS

SEQ ID NO: 106 - protein, 14 aa, Artificial
  P,R,S 103-class Nanobody FW2 sequence
WVRQYPGKEPEWVS

SEQ ID NO: 107 - protein, 14 aa, Artificial
  P,R,S 103-class Nanobody FW2 sequence
WFRQPPGKEHEFVA

SEQ ID NO: 108 - protein, 14 aa, Artificial
  P,R,S 103-class Nanobody FW2 sequence
WYRQAPGKRTELVA

SEQ ID NO: 109 - protein, 14 aa, Artificial
  P,R,S 103-class Nanobody FW2 sequence
WLRQAPGQGLEWVS

SEQ ID NO: 110 - protein, 14 aa, Artificial
  P,R,S 103-class Nanobody FW2 sequence
WLRQTPGKGLEWVG

SEQ ID NO: 111 - protein, 14 aa, Artificial
  P,R,S 103-class Nanobody FW2 sequence
WVRQAPGKAEEFVS

SEQ ID NO: 112 - protein, 32 aa, Artificial
  P,R,S 103-class Nanobody FW3 sequence
RFTISRDNAKNTVYLQMNSLKPEDTAVYYCAA

SEQ ID NO: 113 - protein, 32 aa, Artificial; identical to SEQ ID NO: 81
  P,R,S 103-class Nanobody FW3 sequence

SEQ ID NO: 114 - protein, 32 aa, Artificial
  P,R,S 103-class Nanobody FW3 sequence
RFTISRDNAKNEMYLQMNNLKTEDTGVYWCGA

SEQ ID NO: 115 - protein, 32 aa, Artificial
  P,R,S 103-class Nanobody FW3 sequence
RFTISSDSNRNMIYLQMNNLKPEDTAVYYCAA

SEQ ID NO: 116 - protein, 32 aa, Artificial
  P,R,S 103-class Nanobody FW3 sequence
RFTISRDNAKNMLYLHLNNLKSEDTAVYYCRR

SEQ ID NO: 117 - protein, 32 aa, Artificial
  P,R,S 103-class Nanobody FW3 sequence
RFTISRDNAKKTVYLRLNSLNPEDTAVYSCNL

SEQ ID NO: 118 - protein, 32 aa, Artificial
  P,R,S 103-class Nanobody FW3 sequence
RFKISRDNAKKTLYLQMNSLGPEDTAMYYCQR

SEQ ID NO: 119 - protein, 32 aa, Artificial
  P,R,S 103-class Nanobody FW3 sequence
RFTVSRDNGKNTAYLRMNSLKPEDTADYYCAV

SEQ ID NO: 120 - protein, 11 aa, Artificial
  P,R,S 103-class Nanobody FW4 sequence
RGQGTQVTVSS

SEQ ID NO: 121 - protein, 11 aa, Artificial
  P,R,S 103-class Nanobody FW4 sequence
LRGGTQVTVSS

SEQ ID NO: 122 - protein, 11 aa, Artificial
  P,R,S 103-class Nanobody FW4 sequence
GNKGTLVTVSS

SEQ ID NO: 123 - protein, 11 aa, Artificial
  P,R,S 103-class Nanobody FW4 sequence
SSPGTQVTVSS

SEQ ID NO: 124 - protein, 11 aa, Artificial
  P,R,S 103-class Nanobody FW4 sequence
SSQGTLVTVSS

SEQ ID NO: 125 - protein, 11 aa, Artificial
  P,R,S 103-class Nanobody FW4 sequence
RSRGIQVTVSS

SEQ ID NO: 126 - protein, 30 aa, Artificial
  FR1 sequences
EVQLVESGGGLVQAGGSLRLSCAVSGRTFS

SEQ ID NO: 127 - protein, 30 aa, Artificial
  FR1 sequences
EVQLVESGGGLVQPGGSLRLSCAASGFTFS

SEQ ID NO: 128 - protein, 30 aa, Artificial
  FR1 sequences
EVQLVESGGKLVQAGGSLRLSCAVSGRTSS

SEQ ID NO: 129 - protein, 30 aa, Artificial
  FR1 sequences
KVQLVESGGGLVQTGDSLRLSCAASGRAIG

SEQ ID NO: 130 - protein, 30 aa, Artificial
  FR1 sequences
EVQLVESGGGLVQAGGSLRLSCAASGRTIG

SEQ ID NO: 131 - protein, 30 aa, Artificial
  FR1 sequences
EVQLVESGGGLMQTGGSLRLSCAASGVTYS

SEQ ID NO: 132 - protein, 30 aa, Artificial
  FR1 sequences
EVQLVESEGGPVQSGGSLRLSCAASGRTFS

SEQ ID NO: 133 - protein, 30 aa, Artificial
  FR1 sequences
EVQLVESGGGSVQPGGSLRLSCAASGGTFS

SEQ ID NO: 134 - protein, 30 aa, Artificial
  FR1 sequences
EVQLVESGGGLVQAGGSLRLTCAASGRTFR

SEQ ID NO: 135 - protein, 30 aa, Artificial
  FR1 sequences
EVQLVESGGGLVQAGGSLRLSCAASGITFS

SEQ ID NO: 136 - protein, 30 aa, Artificial
  FR1 sequences
EVQLVESGGGLVQAGGSLRLSCAASGRTFS

SEQ ID NO: 137 - protein, 30 aa, Artificial
  FR1 sequences
EVQLVESGGGWMQAGGSLRLSCAASGRTFT

SEQ ID NO: 138 - protein, 30 aa, Artificial
  FR1 sequences
EVQLVESGGGLVQAGGSLRLSCAASGRTFR

SEQ ID NO: 139 - protein, 30 aa, Artificial
  FR1 sequences
EVQLVESGGGLVQAGGSLRLSCAASGRTSS

SEQ ID NO: 140 - protein, 30 aa, Artificial
  FR1 sequences
EVQLVESGGGLVQAGGSLRLSCAAAGGTFR

SEQ ID NO: 141 - protein, 30 aa, Artificial
  FR1 sequences
EVQLVESGGGLVQAGGSLRLSCVASRRTFS

SEQ ID NO: 142 - protein, 30 aa, Artificial
  FR1 sequences
EVQLVESGGGLVQVGDSLRLSCEASGRSRF

SEQ ID NO: 143 - protein, 30 aa, Artificial; identical to SEQ ID NO: 136
  FR1 sequences

SEQ ID NO: 144 - protein, 30 aa, Artificial
  FR1 sequences
EVQLVESGGGLVQAGDSLRLSCAASGRTVT

SEQ ID NO: 145 - protein, 30 aa, Artificial
  FR1 sequences
EVQLVESGGGLVQAGDSLRLSCAASGRTFT

SEQ ID NO: 146 - protein, 30 aa, Artificial
  FR1 sequences
EVQLVESGGGLVQAGGSLRLSCVASRRTFN

SEQ ID NO: 147 - protein, 30 aa, Artificial
  FR1 sequences
EVQLVESGGGLMQTGGSLRLSCAASERTSR

SEQ ID NO: 148 - protein, 29 aa, Artificial
  FR1 sequences
EVQLVESGGGLVQAGGSLRLSCAASGLTT

SEQ ID NO: 149 - protein, 30 aa, Artificial
  FR1 sequences
EVQLVEAGGGLVQAGDSLRLSCAASGRTIR

SEQ ID NO: 150 - protein, 30 aa, Artificial; identical to SEQ ID NO: 137
  FR1 sequences

SEQ ID NO: 151 - protein, 30 aa, Artificial; identical to SEQ ID NO: 138
  FR1 sequences

SEQ ID NO: 152 - protein, 30 aa, Artificial
  FR1 sequences
EVQLVESGGGLVQAGGSLRLSCAASGLTSS

SEQ ID NO: 153 - protein, 30 aa, Artificial
  FR1 sequences
EVQLVESGGGLVPAGGSLRLSCAASGLTDR

SEQ ID NO: 154 - protein, 30 aa, Artificial; identical to SEQ ID NO: 153
  FR1 sequences

SEQ ID NO: 155 - protein, 30 aa, Artificial; identical to SEQ ID NO: 140
  FR1 sequences

SEQ ID NO: 156 - protein, 30 aa, Artificial
  FR1 sequences
EVQLVESGGGLVQAGGSLTLSCAAAGFTFR

SEQ ID NO: 157 - protein, 30 aa, Artificial
  FR1 sequences
EVQLVESGGGLVQAGGSLRLSCAAAGCTFR

SEQ ID NO: 158 - protein, 30 aa, Artificial; identical to SEQ ID NO: 140
  FR1 sequences

SEQ ID NO: 159 - protein, 30 aa, Artificial; identical to SEQ ID NO: 140
  FR1 sequences

SEQ ID NO: 160 - protein, 30 aa, Artificial
  FR1 sequences
EVQLVESGGGLVQAGGSLRLSCAAAGYTFR

SEQ ID NO: 161 - protein, 30 aa, Artificial
  FR1 sequences
EVQLVESGGGLVQSGGSLRLSCAAAGYTFR

SEQ ID NO: 162 - protein, 30 aa, Artificial; identical to SEQ ID NO: 141
  FR1 sequences

SEQ ID NO: 163 - protein, 30 aa, Artificial
  FR1 sequences
EVQLVESGGGLVQAGGSLRLSCVASKRTFA

SEQ ID NO: 164 - protein, 30 aa, Artificial; identical to SEQ ID NO: 142
  FR1 sequences

SEQ ID NO: 165 - protein, 30 aa, Artificial; identical to SEQ ID NO: 142
  FR1 sequences

SEQ ID NO: 166 - protein, 30 aa, Artificial; identical to SEQ ID NO: 136
  FR1 sequences

SEQ ID NO: 167 - protein, 30 aa, Artificial; identical to SEQ ID NO: 136
  FR1 sequences

SEQ ID NO: 168 - protein, 30 aa, Artificial; identical to SEQ ID NO: 136
  FR1 sequences

SEQ ID NO: 169 - protein, 30 aa, Artificial; identical to SEQ ID NO: 136
  FR1 sequences

SEQ ID NO: 170 - protein, 30 aa, Artificial; identical to SEQ ID NO: 136
  FR1 sequences

SEQ ID NO: 171 - protein, 30 aa, Artificial; identical to SEQ ID NO: 136
  FR1 sequences

SEQ ID NO: 172 - protein, 30 aa, Artificial; identical to SEQ ID NO: 136
  FR1 sequences

SEQ ID NO: 173 - protein, 30 aa, Artificial; identical to SEQ ID NO: 136
  FR1 sequences

SEQ ID NO: 174 - protein, 30 aa, Artificial; identical to SEQ ID NO: 136
  FR1 sequences

SEQ ID NO: 175 - protein, 30 aa, Artificial
  FR1 sequences
EVQLVESGGGLVQAGDSLRLSCAASGRIFT

SEQ ID NO: 176 - protein, 30 aa, Artificial; identical to SEQ ID NO: 145
  FR1 sequences

SEQ ID NO: 177 - protein, 30 aa, Artificial; identical to SEQ ID NO: 145
  FR1 sequences

SEQ ID NO: 178 - protein, 30 aa, Artificial
  FR1 sequences
EVQLVESGGGSVQAGDSLRLSCAASGRTFT

SEQ ID NO: 179 - protein, 30 aa, Artificial; identical to SEQ ID NO: 145
  FR1 sequences

SEQ ID NO: 180 - protein, 30 aa, Artificial; identical to SEQ ID NO: 145
  FR1 sequences

SEQ ID NO: 181 - protein, 30 aa, Artificial; identical to SEQ ID NO: 145
  FR1 sequences

SEQ ID NO: 182 - protein, 30 aa, Artificial; identical to SEQ ID NO: 145
  FR1 sequences

SEQ ID NO: 183 - protein, 30 aa, Artificial; identical to SEQ ID NO: 145
  FR1 sequences

SEQ ID NO: 184 - protein, 30 aa, Artificial
  FR1 sequences
EMQLVESGGGLVQAGGSLRLSCVASKRTFA

SEQ ID NO: 185 - protein, 30 aa, Artificial
  FR1 sequences
EVQLVESGGGLVQTGGSLRLSCVASRRTFS

SEQ ID NO: 186 - protein, 30 aa, Artificial; identical to SEQ ID NO: 140
  FR1 sequences

SEQ ID NO: 187 - protein, 30 aa, Artificial
  FR1 sequences
EVQLVESGGGLVQAGDSLRLSCAAAGFTFR

SEQ ID NO: 188 - protein, 5 aa, Artificial
  Xaa is any amino acid sequence
SSTMA

SEQ ID NO: 189 - protein, 5 aa, Artificial
  Xaa is any amino acid sequence
SYYMS

SEQ ID NO: 190 - protein, 5 aa, Artificial
  Xaa is any amino acid sequence
IYNMA

SEQ ID NO: 191 - protein, 5 aa, Artificial
  Xaa is any amino acid sequence
SYAMG

SEQ ID NO: 192 - protein, 5 aa, Artificial
  Xaa is any amino acid sequence
GHTMA

SEQ ID NO: 193 - protein, 5 aa, Artificial
  Xaa is any amino acid sequence
YYTAS

SEQ ID NO: 194 - protein, 5 aa, Artificial
  Xaa is any amino acid sequence
VSTIA

SEQ ID NO: 195 - protein, 5 aa, Artificial
  Xaa is any amino acid sequence
RYAMG

SEQ ID NO: 196 - protein, 5 aa, Artificial
  Xaa is any amino acid sequence
SYAMG

SEQ ID NO: 197 - protein, 5 aa, Artificial
  Xaa is any amino acid sequence
SRTMG

SEQ ID NO: 198 - protein, 5 aa, Artificial
  Xaa is any amino acid sequence
SKTMG

SEQ ID NO: 199 - protein, 2 aa, Artificial
  Xaa is any amino acid sequence
MA

SEQ ID NO: 200 - protein, 5 aa, Artificial
  Xaa is any amino acid sequence
SYPMG

SEQ ID NO: 201 - protein, 5 aa, Artificial
  Xaa is any amino acid sequence
YYTMS

SEQ ID NO: 202 - protein, 5 aa, Artificial
  Xaa is any amino acid sequence
NYVMG

SEQ ID NO: 203 - protein, 5 aa, Artificial
  Xaa is any amino acid sequence
SYAMG

SEQ ID NO: 204 - protein, 6 aa, Artificial
  Xaa is any amino acid sequence
STYVMG

SEQ ID NO: 205 - protein, 5 aa, Artificial
  Xaa is any amino acid sequence
RSAMG

SEQ ID NO: 206 - protein, 2 aa, Artificial
  Xaa is any amino acid sequence
MG

SEQ ID NO: 207 - protein, 2 aa, Artificial
  Xaa is any amino acid sequence
MG

SEQ ID NO: 208 - protein, 5 aa, Artificial
  Xaa is any amino acid sequence
SYAVG

SEQ ID NO: 209 - protein, 5 aa, Artificial
  Xaa is any amino acid sequence
NYGMG

SEQ ID NO: 210 - protein, 5 aa, Artificial
  Xaa is any amino acid sequence
VYTMA

SEQ ID NO: 211 - protein, 4 aa, Artificial
  Xaa is any amino acid sequence
GTMA

SEQ ID NO: 212 - protein, 2 aa, Artificial
  Xaa is any amino acid sequence
MA

SEQ ID NO: 213 - protein, 5 aa, Artificial
  Xaa is any amino acid sequence
SYPMG

SEQ ID NO: 214 - protein, 5 aa, Artificial
  Xaa is any amino acid sequence
RYTMS

SEQ ID NO: 215 - protein, 5 aa, Artificial
  Xaa is any amino acid sequence
RYTMS

SEQ ID NO: 216 - protein, 5 aa, Artificial
  Xaa is any amino acid sequence
RYTMS

SEQ ID NO: 217 - protein, 5 aa, Artificial
  Xaa is any amino acid sequence
NYVMG

SEQ ID NO: 218 - protein, 5 aa, Artificial
  Xaa is any amino acid sequence
RYVMG

SEQ ID NO: 219 - protein, 5 aa, Artificial
  Xaa is any amino acid sequence
NYVMG

SEQ ID NO: 220 - protein, 5 aa, Artificial
  Xaa is any amino acid sequence
NYVMG

SEQ ID NO: 221 - protein, 5 aa, Artificial
  Xaa is any amino acid sequence
NYVMG

SEQ ID NO: 222 - protein, 5 aa, Artificial
  Xaa is any amino acid sequence
AYVMG

SEQ ID NO: 223 - protein, 7 aa, Artificial
  Xaa is any amino acid sequence
ARAYVMG

SEQ ID NO: 224 - protein, 5 aa, Artificial
  Xaa is any amino acid sequence
SYAMG

SEQ ID NO: 225 - protein, 5 aa, Artificial
  Xaa is any amino acid sequence
SYAMG

SEQ ID NO: 226 - protein, 6 aa, Artificial
  Xaa is any amino acid sequence
STYVMG

SEQ ID NO: 227 - protein, 6 aa, Artificial
  Xaa is any amino acid sequence
STYVMG

SEQ ID NO: 228 - protein, 5 aa, Artificial
  Xaa is any amino acid sequence
RSAMG

SEQ ID NO: 229 - protein, 5 aa, Artificial
  Xaa is any amino acid sequence
RSAMG

SEQ ID NO: 230 - protein, 5 aa, Artificial
  Xaa is any amino acid sequence
RSAMG

SEQ ID NO: 231 - protein, 5 aa, Artificial
  Xaa is any amino acid sequence
RSAMG

SEQ ID NO: 232 - protein, 5 aa, Artificial
  Xaa is any amino acid sequence
ISAMG

SEQ ID NO: 233 - protein, 5 aa, Artificial
  Xaa is any amino acid sequence
RSAMG

SEQ ID NO: 234 - protein, 5 aa, Artificial
  Xaa is any amino acid sequence
RSAMG

SEQ ID NO: 235 - protein, 5 aa, Artificial
  Xaa is any amino acid sequence
RSAMG

SEQ ID NO: 236 - protein, 5 aa, Artificial
  Xaa is any amino acid sequence
RSAMG

SEQ ID NO: 237 - protein, 2 aa, Artificial
  Xaa is any amino acid sequence
MG

SEQ ID NO: 238 - protein, 2 aa, Artificial
  Xaa is any amino acid sequence
MG

SEQ ID NO: 239 - protein, 2 aa, Artificial
  Xaa is any amino acid sequence
MG

SEQ ID NO: 240 - protein, 2 aa, Artificial
  Xaa is any amino acid sequence
MG

SEQ ID NO: 241 - protein, 2 aa, Artificial
  Xaa is any amino acid sequence
MG

SEQ ID NO: 242 - protein, 2 aa, Artificial
  Xaa is any amino acid sequence
MG

SEQ ID NO: 243 - protein, 2 aa, Artificial
  Xaa is any amino acid sequence
MG

SEQ ID NO: 244 - protein, 2 aa, Artificial
  Xaa is any amino acid sequence
MG

SEQ ID NO: 245 - protein, 2 aa, Artificial
  Xaa is any amino acid sequence
MG

SEQ ID NO: 246 - protein, 5 aa, Artificial
  Xaa is any amino acid sequence
SYAMG

SEQ ID NO: 247 - protein, 5 aa, Artificial
  Xaa is any amino acid sequence
SYAVG

SEQ ID NO: 248 - protein, 5 aa, Artificial
  Xaa is any amino acid sequence
NYVMG

SEQ ID NO: 249 - protein, 5 aa, Artificial
  Xaa is any amino acid sequence
RYVMG

SEQ ID NO: 250 - protein, 14 aa, Artificial
  FR2 sequence
WFRQPPGGERDFVA

SEQ ID NO: 251 - protein, 14 aa, Artificial
  FR2 sequence
WVRQAPGKGLEWVS

SEQ ID NO: 252 - protein, 14 aa, Artificial
  FR2 sequence
WFRQGPGKGRESVG

SEQ ID NO: 253 - protein, 14 aa, Artificial
  FR2 sequence
WFRQAPGKEREFVA

SEQ ID NO: 254 - protein, 14 aa, Artificial
  FR2 sequence
WFRQAPGKERDFVA

SEQ ID NO: 255 - protein, 14 aa, Artificial
  FR2 sequence
WFRQAPGKEREFVA

SEQ ID NO: 256 - protein, 14 aa, Artificial
  FR2 sequence
WFRQAPGEGREFVA

SEQ ID NO: 257 - protein, 14 aa, Artificial
  FR2 sequence
WFRQAPGKEREFVS

SEQ ID NO: 258 - protein, 14 aa, Artificial
  FR2 sequence
WFRQAPGKEREFVA

SEQ ID NO: 259 - protein, 14 aa, Artificial
  FR2 sequence
WFRQAPGKEREFVA

SEQ ID NO: 260 - protein, 14 aa, Artificial
  FR2 sequence
WFRQPPGNEREFVA

SEQ ID NO: 261 - protein, 14 aa, Artificial
  FR2 sequence
WFRQAPGKEREFVA

SEQ ID NO: 262 - protein, 14 aa, Artificial
  FR2 sequence
WFRQAPGKEREFVA

SEQ ID NO: 263 - protein, 14 aa, Artificial
  FR2 sequence
WFRQDPGKEREFVA

SEQ ID NO: 264 - protein, 14 aa, Artificial
  FR2 sequence
WFRQAPGKEREFVT

SEQ ID NO: 265 - protein, 14 aa, Artificial
  FR2 sequence
WFRQVPGKERDFVA

SEQ ID NO: 266 - protein, 14 aa, Artificial
  FR2 sequence
WFRQAPGKEREFVA

SEQ ID NO: 267 - protein, 14 aa, Artificial
  FR2 sequence
WFRQAPGKEREFVG

SEQ ID NO: 268 - protein, 14 aa, Artificial
  FR2 sequence
WFRQAPGKEREFVA

SEQ ID NO: 269 - protein, 14 aa, Artificial
  FR2 sequence
WFRQAPGTEREFVA

SEQ ID NO: 270 - protein, 14 aa, Artificial
  FR2 sequence
WFRQVPGEERDFVA

SEQ ID NO: 271 - protein, 14 aa, Artificial
  FR2 sequence
WFRQAPGKEREFVA

SEQ ID NO: 272 - protein, 14 aa, Artificial
  FR2 sequence
WFRQAPGKEREFVA

SEQ ID NO: 273 - protein, 14 aa, Artificial
  FR2 sequence
WFRQAPGKDREFVA

SEQ ID NO: 274 - protein, 14 aa, Artificial
  FR2 sequence
WFRQASGKEREFVA

SEQ ID NO: 275 - protein, 14 aa, Artificial
  FR2 sequence
WFRQAPGKEREFVA

SEQ ID NO: 276 - protein, 14 aa, Artificial
  FR2 sequence
WFRQDPGKEREFVA

SEQ ID NO: 277 - protein, 14 aa, Artificial
  FR2 sequence
WFRQDPGKEREFVA

SEQ ID NO: 278 - protein, 14 aa, Artificial
  FR2 sequence
WFRQDPGKEREFVA

SEQ ID NO: 279 - protein, 14 aa, Artificial
  FR2 sequence
WFRQAPGKEREFVT

SEQ ID NO: 280 - protein, 14 aa, Artificial
  FR2 sequence
WFRQAPGKEREFVA

SEQ ID NO: 281 - protein, 14 aa, Artificial
  FR2 sequence
WFRQAPGKEREFVT

SEQ ID NO: 282 - protein, 14 aa, Artificial
  FR2 sequence
WFRQAPGKEREFVA

SEQ ID NO: 283 - protein, 14 aa, Artificial
  FR2 sequence
WFRQAPGKEREFVT

SEQ ID NO: 284 - protein, 14 aa, Artificial
  FR2 sequence
WFRQAPGKEREFVA

SEQ ID NO: 285 - protein, 14 aa, Artificial
  FR2 sequence
WFRQAPGKEREFVA

SEQ ID NO: 286 - protein, 14 aa, Artificial
  FR2 sequence
WFRQVPGKERDFVA

SEQ ID NO: 287 - protein, 14 aa, Artificial
  FR2 sequence
WFRQVPGKERDFVA

SEQ ID NO: 288 - protein, 14 aa, Artificial
  FR2 sequence
WFRQAPGKEREFVA

SEQ ID NO: 289 - protein, 14 aa, Artificial
  FR2 sequence
WFRQAPGKEREFVA

SEQ ID NO: 290 - protein, 14 aa, Artificial
  FR2 sequence
WFRQAPGKEREFVG

SEQ ID NO: 291 - protein, 14 aa, Artificial
  FR2 sequence
WFRQAPGKEREFVG

SEQ ID NO: 292 - protein, 14 aa, Artificial
  FR2 sequence
WFRQAPGKEREFVG

SEQ ID NO: 293 - protein, 14 aa, Artificial
  FR2 sequence
WFRQAPGKEREFVG

SEQ ID NO: 294 - protein, 14 aa, Artificial
  FR2 sequence
WFRQAPGKEREFVC

SEQ ID NO: 295 - protein, 14 aa, Artificial
  FR2 sequence
WFRQAPGKEREFVG

SEQ ID NO: 296 - protein, 14 aa, Artificial
  FR2 sequence
WFRQAPGKEREFVG

SEQ ID NO: 297 - protein, 14 aa, Artificial
  FR2 sequence
WFRQAPGKEREFVG

SEQ ID NO: 298 - protein, 14 aa, Artificial
  FR2 sequence
WFRQAPGKEREFVG

SEQ ID NO: 299 - protein, 14 aa, Artificial
  FR2 sequence
WFRQAPGKEREFVA

SEQ ID NO: 300 - protein, 14 aa, Artificial
  FR2 sequence
WFRQAPGKEREFVA

SEQ ID NO: 301 - protein, 14 aa, Artificial
  FR2 sequence
WFRRAPGTEREFVA

SEQ ID NO: 302 - protein, 14 aa, Artificial
  FR2 sequence
WFRQAPGTEREFVA

SEQ ID NO: 303 - protein, 14 aa, Artificial
  FR2 sequence
WFRQAPGTEREFVA

SEQ ID NO: 304 - protein, 14 aa, Artificial
  FR2 sequence
WFRQAPGTEREFVA

SEQ ID NO: 305 - protein, 14 aa, Artificial
  FR2 sequence
WFRQAPGTEREFVA

SEQ ID NO: 306 - protein, 14 aa, Artificial
  FR2 sequence
WFRQAPGTEREFVA

SEQ ID NO: 307 - protein, 14 aa, Artificial
  FR2 sequence
WFRQAPGTEREFVA

SEQ ID NO: 308 - protein, 14 aa, Artificial
  FR2 sequence
WFRQVPGKERDFVA

SEQ ID NO: 309 - protein, 14 aa, Artificial
  FR2 sequence
WFRQVPGKERDFVA

SEQ ID NO: 310 - protein, 14 aa, Artificial
  FR2 sequence
WFRQAPGKEREFVT

SEQ ID NO: 311 - protein, 14 aa, Artificial
  FR2 sequence
WFRQAPGKEREFVA

SEQ ID NO: 312 - protein, 17 aa, Artificial
  Xaa is any amino acid sequence
SISTSGTRTLYADSVKG

SEQ ID NO: 313 - protein, 17 aa, Artificial
  Xaa is any amino acid sequence
SIYSDGSTTDYADSVKG

SEQ ID NO: 314 - protein, 17 aa, Artificial
  Xaa is any amino acid sequence
RIYWSDDNTYYADSVKG

SEQ ID NO: 315 - protein, 17 aa, Artificial
  Xaa is any amino acid sequence
VINYRGSSLKYADRVKG

SEQ ID NO: 316 - protein, 17 aa, Artificial
  Xaa is any amino acid sequence
TITSSGSTIFYADSVKG

SEQ ID NO: 317 - protein, 16 aa, Artificial
  Xaa is any amino acid sequence
AISPSGNTYYADSVKG

SEQ ID NO: 318 - protein, 17 aa, Artificial
  Xaa is any amino acid sequence
AIYPSGRNAYVADSVKG

SEQ ID NO: 319 - protein, 17 aa, Artificial
  Xaa is any amino acid sequence
AISVGGTYQYYVDSVKG

SEQ ID NO: 320 - protein, 17 aa, Artificial
  Xaa is any amino acid sequence
AINYSGGSTNYADSVKG

SEQ ID NO: 321 - protein, 17 aa, Artificial
  Xaa is any amino acid sequence
AITPSSRTTYYADSVKG

SEQ ID NO: 322 - protein, 17 aa, Artificial
  Xaa is any amino acid sequence
AITPTSRTTYYADSVKG

SEQ ID NO: 323 - protein, 17 aa, Artificial
  Xaa is any amino acid sequence
AITGSGRSTYYTDSVKG

SEQ ID NO: 324 - protein, 17 aa, Artificial
  Xaa is any amino acid sequence
SITGSGGSTYYADSVKG

SEQ ID NO: 325 - protein, 16 aa, Artificial
  Xaa is any amino acid sequence
AVPLSGNTYYADPVRG

SEQ ID NO: 326 - protein, 17 aa, Artificial
  Xaa is any amino acid sequence
AISTGGSWTGYVDSVKD

SEQ ID NO: 327 - protein, 16 aa, Artificial
  Xaa is any amino acid sequence
AISTGSITIYGDSVKG

SEQ ID NO: 328 - protein, 17 aa, Artificial
  Xaa is any amino acid sequence
AVSWSSGNAYYIDSAKG

SEQ ID NO: 329 - protein, 17 aa, Artificial
  Xaa is any amino acid sequence
FITGSGGTTYYGESVKG

SEQ ID NO: 330 - protein, 17 aa, Artificial
  Xaa is any amino acid sequence
SITGSGSVTNYADSVKG

SEQ ID NO: 331 - protein, 17 aa, Artificial
  Xaa is any amino acid sequence
AISGSGKITNYADSVKG

SEQ ID NO: 332 - protein, 16 aa, Artificial
  Xaa is any amino acid sequence
AISTGSVTIYADSVKG

SEQ ID NO: 333 - protein, 17 aa, Artificial
  Xaa is any amino acid sequence
AITSAGGTTYYGDFVKG

SEQ ID NO: 334 - protein, 17 aa, Artificial
  Xaa is any amino acid sequence
AITRSGKTTYYADSVKG

SEQ ID NO: 335 - protein, 17 aa, Artificial
  Xaa is any amino acid sequence
TVTSSGSTTFYADSVKG

SEQ ID NO: 336 - protein, 17 aa, Artificial
  Xaa is any amino acid sequence
AITGSGRSTYYTDSVKG

SEQ ID NO: 337 - protein, 17 aa, Artificial
  Xaa is any amino acid sequence
SITGSGGSTYYADSVKG

SEQ ID NO: 338 - protein, 16 aa, Artificial
  Xaa is any amino acid sequence
AVPLSGNTYYADPVRG

SEQ ID NO: 339 - protein, 16 aa, Artificial
  Xaa is any amino acid sequence
AVPLSGNTYYADPVRG

SEQ ID NO: 340 - protein, 16 aa, Artificial
  Xaa is any amino acid sequence
AVPLSGNTYYADPVRG

SEQ ID NO: 341 - protein, 17 aa, Artificial
  Xaa is any amino acid sequence
AISTGGSWTGYVDSVKD

SEQ ID NO: 342 - protein, 17 aa, Artificial
  Xaa is any amino acid sequence
AISTGGTWTGYVDSVKD

SEQ ID NO: 343 - protein, 17 aa, Artificial
  Xaa is any amino acid sequence
AISTGGTWTGYVDSVKD

SEQ ID NO: 344 - protein, 17 aa, Artificial
  Xaa is any amino acid sequence
AISTGGSWTGYVDSVKD

SEQ ID NO: 345 - protein, 17 aa, Artificial
  Xaa is any amino acid sequence
AISAGGSWTGYVDSVKD

SEQ ID NO: 346 - protein, 17 aa, Artificial
  Xaa is any amino acid sequence
GISTGGTWTGYVDSVKD

SEQ ID NO: 347 - protein, 17 aa, Artificial
  Xaa is any amino acid sequence
AISTGGTWTGYVDSVKD

SEQ ID NO: 348 - protein, 16 aa, Artificial
  Xaa is any amino acid sequence
AISTGSITIYGDSVKG

SEQ ID NO: 349 - protein, 16 aa, Artificial
  Xaa is any amino acid sequence
AITTGSITIYADSVKG

SEQ ID NO: 350 - protein, 17 aa, Artificial
  Xaa is any amino acid sequence
AVSWSSGNAYYIDSAKG

SEQ ID NO: 351 - protein, 17 aa, Artificial
  Xaa is any amino acid sequence
AISWSSGNAYYIDSAKG

SEQ ID NO: 352 - protein, 17 aa, Artificial
  Xaa is any amino acid sequence
FITGSGGTTYYGESVKG

SEQ ID NO: 353 - protein, 17 aa, Artificial
  Xaa is any amino acid sequence
FITGSGGTTYYGESVKG

SEQ ID NO: 354 - protein, 17 aa, Artificial
  Xaa is any amino acid sequence
FITGSGGTTYYGESVKG

SEQ ID NO: 355 - protein, 17 aa, Artificial
  Xaa is any amino acid sequence
FITGSGGTTYYGESVKG

SEQ ID NO: 356 - protein, 17 aa, Artificial
  Xaa is any amino acid sequence
FITGSGGTTYYGESVKG

SEQ ID NO: 357 - protein, 17 aa, Artificial
  Xaa is any amino acid sequence
FITGSGGTTYYGESVKG

SEQ ID NO: 358 - protein, 17 aa, Artificial
  Xaa is any amino acid sequence
FITGSGGTTYYGESVKG

SEQ ID NO: 359 - protein, 17 aa, Artificial
  Xaa is any amino acid sequence
FITGSGGTTYYGESVKG

SEQ ID NO: 360 - protein, 17 aa, Artificial
  Xaa is any amino acid sequence
FITGSGGTTYYGESVKG

SEQ ID NO: 361 - protein, 17 aa, Artificial
  Xaa is any amino acid sequence
AISGSGSITNYADSVKG

SEQ ID NO: 362 - protein, 17 aa, Artificial
  Xaa is any amino acid sequence
FISGSGSVTNYTDSVKG

SEQ ID NO: 363 - protein, 17 aa, Artificial
  Xaa is any amino acid sequence
SISGSGKITNYADSVKG

SEQ ID NO: 364 - protein, 17 aa, Artificial
  Xaa is any amino acid sequence
AISGSGKITNYADSVKG

SEQ ID NO: 365 - protein, 17 aa, Artificial
  Xaa is any amino acid sequence
AISGSGKITNYADSVKG

SEQ ID NO: 366 - protein, 17 aa, Artificial
  Xaa is any amino acid sequence
AISGSGKITNYADSVKG

SEQ ID NO: 367 - protein, 17 aa, Artificial
  Xaa is any amino acid sequence
AISGSGKITNYADSVKG

SEQ ID NO: 368 - protein, 17 aa, Artificial
  Xaa is any amino acid sequence
AISGSGKITNYADSVKG

SEQ ID NO: 369 - protein, 17 aa, Artificial
  Xaa is any amino acid sequence
AISGSGKITNYADSVKG

SEQ ID NO: 370 - protein, 16 aa, Artificial
  Xaa is any amino acid sequence
AISTHSITVYADSVKG

SEQ ID NO: 371 - protein, 16 aa, Artificial
  Xaa is any amino acid sequence
AISTGSVTIYADSVKG

SEQ ID NO: 372 - protein, 17 aa, Artificial
  Xaa is any amino acid sequence
AISTGGSWTGYVDSVKD

SEQ ID NO: 373 - protein, 17 aa, Artificial
  Xaa is any amino acid sequence
AISTGGTWTGYVDSVKD

SEQ ID NO: 374 - protein, 32 aa, Artificial
  FR3 sequence
RFTISRDNAKSTGYLQMNSLKPEDTAVYFCAA

SEQ ID NO: 375 - protein, 32 aa, Artificial
  FR3 sequence
RFTISRDNAKNTLNLQMNSLKSEDTAVYYCAK

SEQ ID NO: 376 - protein, 32 aa, Artificial
  FR3 sequence
RFTISRDNATNTVYLQMNSLKPEDTAVYYCAG

SEQ ID NO: 377 - protein, 32 aa, Artificial
  FR3 sequence
RFTISRDNAKNMVYLQMNSLKPDDTAVYYCAA

SEQ ID NO: 378 - protein, 32 aa, Artificial
  FR3 sequence
RFTISRDNGKKTMTLEMDSLKPEDTAVYYCAA

SEQ ID NO: 379 - protein, 32 aa, Artificial
  FR3 sequence
RFTISRDNGKHTMYLQMNSLNPEDTAVYFCAI

SEQ ID NO: 380 - protein, 32 aa, Artificial
  FR3 sequence
RFTISRDNAKKTVYLQMNSLKPEDTAAYYCAA

SEQ ID NO: 381 - protein, 32 aa, Artificial
  FR3 sequence
RFTISRDNAESTVYLQMNSLKPEDTAVYYCAG

SEQ ID NO: 382 - protein, 32 aa, Artificial
  FR3 sequence
RFTISRDNAKNTLYLQMNSLEPEDTAVYYCAA

SEQ ID NO: 383 - protein, 32 aa, Artificial
  FR3 sequence
RFTISRDNAKNTVLLQMNSLKPEDTAVYYCAA

SEQ ID NO: 384 - protein, 32 aa, Artificial
  FR3 sequence
RFTISRDNAKNTVSLQMNSLKFEDTAAYYCVA

SEQ ID NO: 385 - protein, 32 aa, Artificial
  FR3 sequence
RFTISRDNAKNTAYLQMKSLKPEDTAVYYCAG

SEQ ID NO: 386 - protein, 32 aa, Artificial
  FR3 sequence
RFTISRDNAKNTVYLQMNSLRPEDTAVYSCAA

SEQ ID NO: 387 - protein, 32 aa, Artificial
  FR3 sequence
RFTISRDNAKNTADLQMNSLKPEDTAVYYCAA

SEQ ID NO: 388 - protein, 32 aa, Artificial
  FR3 sequence
RFTISRDNTKNTVYLQMASLKPEDTAVYYCAA

SEQ ID NO: 389 - protein, 32 aa, Artificial; identical to SEQ ID NO: 112
  FR3 sequence

SEQ ID NO: 390 - protein, 32 aa, Artificial
  FR3 sequence
RFATSRDTAKNIMYLQMNSLKPEDTAVYTCAA

SEQ ID NO: 391 - protein, 32 aa, Artificial
  FR3 sequence
RFTISRDNAQNPVYLQMNSLKPEDTAVYYCGV

SEQ ID NO: 392 - protein, 32 aa, Artificial
  FR3 sequence
RFTISRDNAKNTVFLQMNSLKPEDTAVYYCAA

SEQ ID NO: 393 - protein, 32 aa, Artificial
  FR3 sequence
RFTISRDHAKNTVFLQMDSLKPEDTAVYYCAG

SEQ ID NO: 394 - protein, 32 aa, Artificial; identical to SEQ ID NO: 112
  FR3 sequence

SEQ ID NO: 395 - protein, 32 aa, Artificial
  FR3 sequence
RFTISRDSAKYTVYLQMNSLKPEDTAVYWCAA

SEQ ID NO: 396 - protein, 32 aa, Artificial
  FR3 sequence
RFTISRDNAKNTVNLQMNSLKPDDTAVYYCAA

SEQ ID NO: 397 - protein, 32 aa, Artificial
  FR3 sequence
RFTISRDNAENTVNLQMDSLKPEDTAVYYCAA

SEQ ID NO: 398 - protein, 32 aa, Artificial; identical to SEQ ID NO: 385
  FR3 sequence

SEQ ID NO: 399 - protein, 32 aa, Artificial; identical to SEQ ID NO: 386
  FR3 sequence

SEQ ID NO: 400 - protein, 32 aa, Artificial
  FR3 sequence
RFTISRDNAKNTVDLQMNSLKPEDTAVYYCAA

SEQ ID NO: 401 - protein, 32 aa, Artificial; identical to SEQ ID NO: 400
  FR3 sequence

SEQ ID NO: 402 - protein, 32 aa, Artificial; identical to SEQ ID NO: 400
  FR3 sequence

SEQ ID NO: 403 - protein, 32 aa, Artificial; identical to SEQ ID NO: 388
  FR3 sequence

SEQ ID NO: 404 - protein, 32 aa, Artificial
  FR3 sequence
RFTISRDNTKNTVYLQMASLKPEDTAVYNCAA

SEQ ID NO: 405 - protein, 32 aa, Artificial
  FR3 sequence
RFTISRDNTKNTVNLQMASLKPEDTAVYYCAA

SEQ ID NO: 406 - protein, 32 aa, Artificial
  FR3 sequence
RFTISRDNTKNTVYLQMVSLKPEDTAVYYCAA

SEQ ID NO: 407 - protein, 32 aa, Artificial; identical to SEQ ID NO: 388
  FR3 sequence

SEQ ID NO: 408 - protein, 32 aa, Artificial; identical to SEQ ID NO: 388
  FR3 sequence

SEQ ID NO: 409 - protein, 32 aa, Artificial
  FR3 sequence
RFTISRDNTKNTMYLQMASLKPEDTAVYYCAA

SEQ ID NO: 410 - protein, 32 aa, Artificial; identical to SEQ ID NO: 112
  FR3 sequence

SEQ ID NO: 411 - protein, 32 aa, Artificial
  FR3 sequence
RFAISRDNAKNTVYLQMNSLKPEDTAVYYCAA

SEQ ID NO: 412 - protein, 32 aa, Artificial; identical to SEQ ID NO: 390
  FR3 sequence

SEQ ID NO: 413 - protein, 32 aa, Artificial
  FR3 sequence
RFATSRDTAKNIMYLQMNSLKPEDTAVYSCAA

SEQ ID NO: 414 - protein, 32 aa, Artificial; identical to SEQ ID NO: 391
  FR3 sequence

SEQ ID NO: 415 - protein, 32 aa, Artificial
  FR3 sequence
RFTISRDNAQNPVYLQMNSLKPEDTAVYYCAV

SEQ ID NO: 416 - protein, 32 aa, Artificial; identical to SEQ ID NO: 391
  FR3 sequence

SEQ ID NO: 417 - protein, 32 aa, Artificial; identical to SEQ ID NO: 391
  FR3 sequence

SEQ ID NO: 418 - protein, 32 aa, Artificial; identical to SEQ ID NO: 391
  FR3 sequence

SEQ ID NO: 419 - protein, 32 aa, Artificial; identical to SEQ ID NO: 391
  FR3 sequence

SEQ ID NO: 420 - protein, 32 aa, Artificial; identical to SEQ ID NO: 391
  FR3 sequence

SEQ ID NO: 421 - protein, 32 aa, Artificial; identical to SEQ ID NO: 415
  FR3 sequence

SEQ ID NO: 422 - protein, 32 aa, Artificial; identical to SEQ ID NO: 391
  FR3 sequence

SEQ ID NO: 423 - protein, 32 aa, Artificial
  FR3 sequence
RFTISRDYAKTTVFLQMNSLKPEDTAVYYCAA

SEQ ID NO: 424 - protein, 32 aa, Artificial
  FR3 sequence
RFTISRDHAKNTVFLQMNSLKPEDTAVYYCAA

SEQ ID NO: 425 - protein, 32 aa, Artificial
  FR3 sequence
RFTISRDHAKNAVFLQMDGLKPEDTAVYYCAA

SEQ ID NO: 426 - protein, 32 aa, Artificial
  FR3 sequence
RFTISRDHAMNTVFLQMDSLKPEDTAVYYCAA

SEQ ID NO: 427 - protein, 32 aa, Artificial
  FR3 sequence
RFTISRDHAKNTVFLQMDSLKPEDTAVYYCAA

SEQ ID NO: 428 - protein, 32 aa, Artificial; identical to SEQ ID NO: 427
  FR3 sequence

SEQ ID NO: 429 - protein, 32 aa, Artificial; identical to SEQ ID NO: 427
  FR3 sequence

SEQ ID NO: 430 - protein, 32 aa, Artificial; identical to SEQ ID NO: 427
  FR3 sequence

SEQ ID NO: 431 - protein, 32 aa, Artificial; identical to SEQ ID NO: 427
  FR3 sequence

SEQ ID NO: 432 - protein, 32 aa, Artificial
  FR3 sequence
RFTISRDNAKNTVYLQMNTLKPEDTAVYYCAA

SEQ ID NO: 433 - protein, 32 aa, Artificial
  FR3 sequence
RFTISRDNTKNTVYLQMNSLKPEDTAVYYCAA

SEQ ID NO: 434 - protein, 32 aa, Artificial
  FR3 sequence
RFTISRDNTKNTVYLHMASLKPEDTAVYYCAA

SEQ ID NO: 435 - protein, 32 aa, Artificial; identical to SEQ ID NO: 404
  FR3 sequence

SEQ ID NO: 436 - protein, 17 aa, Artificial
  Xaa is any amino acid sequence
VNRRGWEFWRLASGYDY

SEQ ID NO: 437 - protein, 11 aa, Artificial
  Xaa is any amino acid sequence
DANSGGLEYDY

SEQ ID NO: 438 - protein, 11 aa, Artificial
  Xaa is any amino acid sequence
KTTKWSLEYDY

SEQ ID NO: 439 - protein, 16 aa, Artificial
  Xaa is any amino acid sequence
QTSGADFGTTPQRYTY

SEQ ID NO: 440 - protein, 15 aa, Artificial
  Xaa is any amino acid sequence
RIRGKVTVDNFDYAY

SEQ ID NO: 441 - protein, 14 aa, Artificial
  Xaa is any amino acid sequence
RATDSIYYASSYRH

SEQ ID NO: 442 - protein, 15 aa, Artificial
  Xaa is any amino acid sequence
HQPSGSYYSAEAYAY

SEQ ID NO: 443 - protein, 18 aa, Artificial
  Xaa is any amino acid sequence
DASPYGYLREYTATRFDY

SEQ ID NO: 444 - protein, 18 aa, Artificial
  Xaa is any amino acid sequence
GSGYASLSYYSTERAYTY

SEQ ID NO: 445 - protein, 16 aa, Artificial
  Xaa is any amino acid sequence
ERTYGSNYTRPTAWNY

SEQ ID NO: 446 - protein, 16 aa, Artificial
  Xaa is any amino acid sequence
VRRYGSPPHDGSSYEY

SEQ ID NO: 447 - protein, 16 aa, Artificial
  Xaa is any amino acid sequence
LRGLGLEYDSAKSYSY

SEQ ID NO: 448 - protein, 17 aa, Artificial
  Xaa is any amino acid sequence
YIRPDTYLSRDYRKYDY

SEQ ID NO: 449 - protein, 14 aa, Artificial
  Xaa is any amino acid sequence
RASGSIYNRGSYAY

SEQ ID NO: 450 - protein, 17 aa, Artificial
  Xaa is any amino acid sequence
TTPATTYLPRSERQYDY

SEQ ID NO: 451 - protein, 18 aa, Artificial
  Xaa is any amino acid sequence
GKREPYLRQYTASNPYDY

SEQ ID NO: 452 - protein, 18 aa, Artificial
  Xaa is any amino acid sequence
GRGYGLLSEYTQAPRYDY

SEQ ID NO: 453 - protein, 18 aa, Artificial
  Xaa is any amino acid sequence
YRRTYISSTYSESSEYDY

SEQ ID NO: 454 - protein, 18 aa, Artificial
  Xaa is any amino acid sequence
YLPSPYYSSYYDSTKYEY

SEQ ID NO: 455 - protein, 18 aa, Artificial
  Xaa is any amino acid sequence
YLRSPYYSSFYDSAKYEY

SEQ ID NO: 456 - protein, 18 aa, Artificial
  Xaa is any amino acid sequence
GNREPYLRQYTASNPYDY

SEQ ID NO: 457 - protein, 16 aa, Artificial
  Xaa is any amino acid sequence
KLQIGGRWHNLNDYGY

SEQ ID NO: 458 - protein, 14 aa, Artificial
  Xaa is any amino acid sequence
KALLGMTNPAGYEY

SEQ ID NO: 459 - protein, 15 aa, Artificial
  Xaa is any amino acid sequence
RIRGKVTPSNYDYAY

SEQ ID NO: 460 - protein, 16 aa, Artificial
  Xaa is any amino acid sequence
LRGLGLEYDSAKSYSY

SEQ ID NO: 461 - protein, 17 aa, Artificial
  Xaa is any amino acid sequence
YIRPDTYLSRDYRKYDY

SEQ ID NO: 462 - protein, 14 aa, Artificial
  Xaa is any amino acid sequence
RASGSIFNRGSYAY

SEQ ID NO: 463 - protein, 14 aa, Artificial
  Xaa is any amino acid sequence
RASGSIFNRGSYAY

SEQ ID NO: 464 - protein, 14 aa, Artificial
  Xaa is any amino acid sequence
RASGSIFNRGSYAY

SEQ ID NO: 465 - protein, 17 aa, Artificial
  Xaa is any amino acid sequence
TMPATTYLPRSERQYDY

SEQ ID NO: 466 - protein, 17 aa, Artificial
  Xaa is any amino acid sequence
TTPTTSYLPRSERQYEY

SEQ ID NO: 467 - protein, 17 aa, Artificial
  Xaa is any amino acid sequence
TTPTTSYLPRSERQYEY

SEQ ID NO: 468 - protein, 17 aa, Artificial
  Xaa is any amino acid sequence
TTPATTYLPRSERQYDY

SEQ ID NO: 469 - protein, 17 aa, Artificial
  Xaa is any amino acid sequence
TTPATTYLPRSERQYDY

SEQ ID NO: 470 - protein, 17 aa, Artificial
  Xaa is any amino acid sequence
TTPVTSYLPRSERQYEH

SEQ ID NO: 471 - protein, 17 aa, Artificial
  Xaa is any amino acid sequence
TTPSTSYLPRSERQYEY

SEQ ID NO: 472 - protein, 18 aa, Artificial
  Xaa is any amino acid sequence
GKREPYLRQYTASNPYDY

SEQ ID NO: 473 - protein, 18 aa, Artificial
  Xaa is any amino acid sequence
GNREPYLRQYTASNPYDY

SEQ ID NO: 474 - protein, 18 aa, Artificial
  Xaa is any amino acid sequence
GRGYGLLSEYTQAPRYDY

SEQ ID NO: 475 - protein, 18 aa, Artificial
  Xaa is any amino acid sequence
GRGYGLLSEYTQAARYDY

SEQ ID NO: 476 - protein, 18 aa, Artificial
  Xaa is any amino acid sequence
YRRTYISSTYSESSEYDY

SEQ ID NO: 477 - protein, 18 aa, Artificial
  Xaa is any amino acid sequence
YRRTYISSTYNESSEYDY

SEQ ID NO: 478 - protein, 18 aa, Artificial
  Xaa is any amino acid sequence
YRRTYISSTYSESSEYDY

SEQ ID NO: 479 - protein, 18 aa, Artificial
  Xaa is any amino acid sequence
YRRTYISITYSESSDYDY

SEQ ID NO: 480 - protein, 18 aa, Artificial
  Xaa is any amino acid sequence
YRRTYISSTYSESSEYDY

SEQ ID NO: 481 - protein, 18 aa, Artificial
  Xaa is any amino acid sequence
YRRTYISSTYSESSEYDY

SEQ ID NO: 482 - protein, 18 aa, Artificial
  Xaa is any amino acid sequence
YRRTYISSTYSESSEYDY

SEQ ID NO: 483 - protein, 18 aa, Artificial
  Xaa is any amino acid sequence
YRRTYISSTYNESSEYDY

SEQ ID NO: 484 - protein, 18 aa, Artificial
  Xaa is any amino acid sequence
YRRTYISSTYSESSEYDY

SEQ ID NO: 485 - protein, 18 aa, Artificial
  Xaa is any amino acid sequence
YVRTPYYSSYYDSTKYEY

SEQ ID NO: 486 - protein, 18 aa, Artificial
  Xaa is any amino acid sequence
YLRGPYYSSFYDSTKYEY

SEQ ID NO: 487 - protein, 18 aa, Artificial
  Xaa is any amino acid sequence
YLRSPYYSSYYDSAKYEY

SEQ ID NO: 488 - protein, 18 aa, Artificial
  Xaa is any amino acid sequence
YLRSPYYSSYYDSAKYEY

SEQ ID NO: 489 - protein, 18 aa, Artificial
  Xaa is any amino acid sequence
YLRSPYYSSYYDSAKYEY

SEQ ID NO: 490 - protein, 18 aa, Artificial
  Xaa is any amino acid sequence
YLRSPYYSSYYDSAKYEY

SEQ ID NO: 491 - protein, 18 aa, Artificial
  Xaa is any amino acid sequence
YLRSPYYSSYYDSAKYEY

SEQ ID NO: 492 - protein, 18 aa, Artificial
  Xaa is any amino acid sequence
YLRSPYYSSYYDSAKYEY

SEQ ID NO: 493 - protein, 18 aa, Artificial
  Xaa is any amino acid sequence
YLRSPYYSSYYDSAKYEY

SEQ ID NO: 494 - protein, 18 aa, Artificial
  Xaa is any amino acid sequence
GNREPYLRQYTASNPYDY

SEQ ID NO: 495 - protein, 18 aa, Artificial
  Xaa is any amino acid sequence
GNREPYLRQYTASNPYDY

SEQ ID NO: 496 - protein, 17 aa, Artificial
  Xaa is any amino acid sequence
TTPVTTYLPRSERQYDY

SEQ ID NO: 497 - protein, 17 aa, Artificial
  Xaa is any amino acid sequence
TTPTTSYLPRSERQYEY

SEQ ID NO: 498 - protein, 11 aa, Artificial
  FR4 sequence
WGLGAQVTVSS

SEQ ID NO: 499 - protein, 11 aa, Artificial
  FR4 sequence
WGQGTQVTVSS

SEQ ID NO: 500 - protein, 11 aa, Artificial
  FR4 sequence
WGQGTQVTVSS

SEQ ID NO: 501 - protein, 11 aa, Artificial
  FR4 sequence
WGQGTQVTVSS

SEQ ID NO: 502 - protein, 11 aa, Artificial
  FR4 sequence
WGQGTQVTVSS

SEQ ID NO: 503 - protein, 11 aa, Artificial
  FR4 sequence
WGQGTQVTVSS

SEQ ID NO: 504 - protein, 11 aa, Artificial
  FR4 sequence
WGQGTQVTVSS

SEQ ID NO: 505 - protein, 11 aa, Artificial
  FR4 sequence
WGQGTQVTVSS

SEQ ID NO: 506 - protein, 11 aa, Artificial
  FR4 sequence
WGQGTQVTVSS

SEQ ID NO: 507 - protein, 11 aa, Artificial
  FR4 sequence
WGQGTQVTVSS

SEQ ID NO: 508 - protein, 11 aa, Artificial
  FR4 sequence
WGQGTQVTVSS

SEQ ID NO: 509 - protein, 11 aa, Artificial
  FR4 sequence
WGQGTQVTVSS

SEQ ID NO: 510 - protein, 11 aa, Artificial
  FR4 sequence
WGQGTQVTVSS

SEQ ID NO: 511 - protein, 11 aa, Artificial
  FR4 sequence
WGQGTQVTVSS

SEQ ID NO: 512 - protein, 11 aa, Artificial
  FR4 sequence
WGQGTQVTVSS

SEQ ID NO: 513 - protein, 11 aa, Artificial
  FR4 sequence
WGQGTQVTVSS

SEQ ID NO: 514 - protein, 11 aa, Artificial
  FR4 sequence
WGQGTQVTVSS

SEQ ID NO: 515 - protein, 11 aa, Artificial
  FR4 sequence
WGQGTQVTVSS

SEQ ID NO: 516 - protein, 11 aa, Artificial
  FR4 sequence
WGQGTQVTVSS

SEQ ID NO: 517 - protein, 11 aa, Artificial
  FR4 sequence
WGQGTQVTVSS

SEQ ID NO: 518 - protein, 11 aa, Artificial
  FR4 sequence
WGQGTQVTVSS

SEQ ID NO: 519 - protein, 11 aa, Artificial
  FR4 sequence
RGQGTQVTVSS

SEQ ID NO: 520 - protein, 11 aa, Artificial
  FR4 sequence
WGQETQVTVSS

SEQ ID NO: 521 - protein, 11 aa, Artificial
  FR4 sequence
WGQGTQVTVSS

SEQ ID NO: 522 - protein, 11 aa, Artificial
  FR4 sequence
WGQGTQVTVSS

SEQ ID NO: 523 - protein, 11 aa, Artificial
  FR4 sequence
WGQGTQVTVSS

SEQ ID NO: 524 - protein, 11 aa, Artificial
  FR4 sequence
WGQGTQVTVSS

SEQ ID NO: 525 - protein, 11 aa, Artificial
  FR4 sequence
WGQGTQVTVSS

SEQ ID NO: 526 - protein, 11 aa, Artificial
  FR4 sequence
WGQGTQVTVSS

SEQ ID NO: 527 - protein, 11 aa, Artificial
  FR4 sequence
WGQGTQVTVSS

SEQ ID NO: 528 - protein, 11 aa, Artificial
  FR4 sequence
WGQGTQVTVSS

SEQ ID NO: 529 - protein, 11 aa, Artificial
  FR4 sequence
WGQGTQVTVSS

SEQ ID NO: 530 - protein, 11 aa, Artificial
  FR4 sequence
WGQGTQVTVSS

SEQ ID NO: 531 - protein, 11 aa, Artificial
  FR4 sequence
WGQGTQVTVSS

SEQ ID NO: 532 - protein, 11 aa, Artificial
  FR4 sequence
WGQGTQVTVSS

SEQ ID NO: 533 - protein, 11 aa, Artificial
  FR4 sequence
WGQGTQVTVSS

SEQ ID NO: 534 - protein, 11 aa, Artificial
  FR4 sequence
WGQGTQVTVSS

SEQ ID NO: 535 - protein, 11 aa, Artificial
  FR4 sequence
WGQGTQVTVSS

SEQ ID NO: 536 - protein, 11 aa, Artificial
  FR4 sequence
WGQGTQVTVSS

SEQ ID NO: 537 - protein, 11 aa, Artificial
  FR4 sequence
WGQGTQVTVSS

SEQ ID NO: 538 - protein, 11 aa, Artificial
  FR4 sequence
WGQGTQVTVSS

SEQ ID NO: 539 - protein, 11 aa, Artificial
  FR4 sequence
WGQGTQVTVSS

SEQ ID NO: 540 - protein, 11 aa, Artificial
  FR4 sequence
WGQGTQVTVSS

SEQ ID NO: 541 - protein, 11 aa, Artificial
  FR4 sequence
WGQGTQVTVSS

SEQ ID NO: 542 - protein, 11 aa, Artificial
  FR4 sequence
WGQGTQVTVSS

SEQ ID NO: 543 - protein, 11 aa, Artificial
  FR4 sequence
WGQGTQVTVSS

SEQ ID NO: 544 - protein, 11 aa, Artificial
  FR4 sequence
WGQGTQVTVSS

SEQ ID NO: 545 - protein, 11 aa, Artificial
  FR4 sequence
WGQGTQVTVSS

SEQ ID NO: 546 - protein, 11 aa, Artificial
  FR4 sequence
WGQGTQVTVSS

SEQ ID NO: 547 - protein, 11 aa, Artificial
  FR4 sequence
WGQGTQVTVSS

SEQ ID NO: 548 - protein, 11 aa, Artificial
  FR4 sequence
WGQGTQVTVSS

SEQ ID NO: 549 - protein, 11 aa, Artificial
  FR4 sequence
WGQGTQVTVSS

SEQ ID NO: 550 - protein, 11 aa, Artificial
  FR4 sequence
WGQGTQVTVSS

SEQ ID NO: 551 - protein, 11 aa, Artificial
  FR4 sequence
WGQGTQVTVSS

SEQ ID NO: 552 - protein, 11 aa, Artificial
  FR4 sequence
WGQGTQVTVSS

SEQ ID NO: 553 - protein, 11 aa, Artificial
  FR4 sequence
WGQGTQVTVSS

SEQ ID NO: 554 - protein, 11 aa, Artificial
  FR4 sequence
WGQGTQVTVSS

SEQ ID NO: 555 - protein, 11 aa, Artificial
  FR4 sequence
WGQGTQVTVSS

SEQ ID NO: 556 - protein, 11 aa, Artificial
  FR4 sequence
WGQGTQVTVSS

SEQ ID NO: 557 - protein, 11 aa, Artificial
  FR4 sequence
WGQGTQVTVSS

SEQ ID NO: 558 - protein, 11 aa, Artificial
  FR4 sequence
WGQGTQVTVSS

SEQ ID NO: 559 - protein, 11 aa, Artificial
  FR4 sequence
WGQGTQVTVSS

SEQ ID NO: 560 - protein, 126 aa, Artificial
  Nanobody sequence
EVQLVESGGGLVQAGGSLRLSCAVSGRTFSSSTMAWFRQPPGGERDFVASISTSGTRTLYADSVKGRFTISRDNAKSTGYLQMNSLKPEDTAVYFCAAVNRRGWEFWRLASGYDYWGLGAQVTVSS

SEQ ID NO: 561 - protein, 120 aa, Artificial
  Nanobody sequence
EVQLVESGGGLVQPGGSLRLSCAASGFTFSSYYMSWVRQAPGKGLEWVSSIYSDGSTTDYADSVKGRFTISRDNAKNTLNLQMNSLKSEDTAVYYCAKDANSGGLEYDYWGQGTQVTVSS

SEQ ID NO: 562 - protein, 120 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 563 - protein, 125 aa, Artificial
  Nanobody sequence
KVQLVESGGGLVQTGDSLRLSCAASGRAIGSYAMGWFRQAPGKEREFVAVINYRGSSLKYADRVKGRFTISRDNAKNMVYLQMNSLKPDDTAVYYCAAQTSGADFGTTPQRYTYWGQGTQVTVSS

SEQ ID NO: 564 - protein, 124 aa, Artificial
  Nanobody sequence
EVQLVESGGGLVQAGGSLRLSCAASGRTIGGHTMAWFRQAPGKERDFVATITSSGSTIFYADSVKGRFTISRDNGKKTMTLEMDSLKPEDTAVYYCAARIRGKVTVDNFDYAYWGQGTQVTVSS

SEQ ID NO: 565 - protein, 122 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 566 - protein, 124 aa, Artificial
  Nanobody sequence
EVQLVESEGGPVQSGGSLRLSCAASGRTFSVSTIAWFRQAPGEGREFVAAIYPSGRNAYVADSVKGRFTISRDNAKKTVYLQMNSLKPEDTAAYYCAAHQPSGSYYSAEAYAYWGQGTQVTVSS

SEQ ID NO: 567 - protein, 127 aa, Artificial
  Nanobody sequence
EVQLVESGGGSVQPGGSLRLSCAASGGTFSRYAMGWFRQAPGKEREFVSAISVGGTYQYYVDSVKGRFTISRDNAESTVYLQMNSLKPEDTAVYYCAGDASPYGYLREYTATRFDYWGQGTQVTVSS

SEQ ID NO: 568 - protein, 127 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 569 - protein, 125 aa, Artificial
  Nanobody sequence
EVQLVESGGGLVQAGGSLRLSCAASGITFSSRTMGWFRQAPGKEREFVAAITPSSRTTYYADSVKGRFTISRDNAKNTVLLQMNSLKPEDTAVYYCAAERTYGSNYTRPTAWNYWGQGTQVTVSS

SEQ ID NO: 570 - protein, 125 aa, Artificial
  Nanobody sequence
EVQLVESGGGLVQAGGSLRLSCAASGRTFSSKTMGWFRQPPGNEREFVAAITPTSRTTYYADSVKGRFTISRDNAKNTVSLQMNSLKFEDTAAYYCVAVRRYGSPPHDGSSYEYWGQGTQVTVSS

SEQ ID NO: 571 - protein, 122 aa, Artificial
  Nanobody sequence
EVQLVESGGGWMQAGGSLRLSCAASGRTFTMAWFRQAPGKEREFVAAITGSGRSTYYTDSVKGRFTISRDNAKNTAYLQMKSLKPEDTAVYYCAGLRGLGLEYDSAKSYSYWGQGTQVTVSS

SEQ ID NO: 572 - protein, 126 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 573 - protein, 122 aa, Artificial
  Nanobody sequence
EVQLVESGGGLVQAGGSLRLSCAASGRTSSYYTMSWFRQDPGKEREFVAAVPLSGNTYYADPVRGRFTISRDNAKNTADLQMNSLKPEDTAVYYCAARASGSIYNRGSYAYWGQGTQVTVSS

SEQ ID NO: 574 - protein, 126 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 575 - protein, 126 aa, Artificial
  Nanobody sequence
EVQLVESGGGLVQAGGSLRLSCVASRRTFSSYAMGWFRQVPGKERDFVAAISTGSITIYGDSVKGRFTISRDNAKNTVYLQMNSLKPEDTAVYYCAAGKREPYLRQYTASNPYDYWGQGTQVTVSS

SEQ ID NO: 576 - protein, 128 aa, Artificial
  Nanobody sequence
EVQLVESGGGLVQVGDSLRLSCEASGRSRFSTYVMGWFRQAPGKEREFVAAVSWSSGNAYYIDSAKGRFATSRDTAKNIMYLQMNSLKPEDTAVYTCAAGRGYGLLSEYTQAPRYDYWGQGTQVTVSS

SEQ ID NO: 577 - protein, 150 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSAAAEQKLISEEDLNGAAHHHHHH

SEQ ID NO: 578 - protein, 124 aa, Artificial
  Nanobody sequence
EVQLVESGGGLVQAGDSLRLSCAASGRTVTMGWFRQAPGKEREFVASITGSGSVTNYADSVKGRFTISRDNAKNTVFLQMNSLKPEDTAVYYCAAYLPSPYYSSYYDSTKYEYWGQGTQVTVSS

SEQ ID NO: 579 - protein, 124 aa, Artificial
  Nanobody sequence
EVQLVESGGGLVQAGDSLRLSCAASGRTFTMGWFRQAPGTEREFVAAISGSGKITNYADSVKGRFTISRDHAKNTVFLQMDSLKPEDTAVYYCAGYLRSPYYSSFYDSAKYEYWGQGTQVTVSS

SEQ ID NO: 580 - protein, 126 aa, Artificial
  Nanobody sequence
EVQLVESGGGLVQAGGSLRLSCVASRRTFNSYAVGWFRQVPGEERDFVAAISTGSVTIYADSVKGRFTISRDNAKNTVYLQMNSLKPEDTAVYYCAAGNREPYLRQYTASNPYDYWGQGTQVTVSS

SEQ ID NO: 581 - protein, 125 aa, Artificial
  Nanobody sequence
EVQLVESGGGLMQTGGSLRLSCAASERTSRNYGMGWFRQAPGKEREFVAAITSAGGTTYYGDFVKGRFTISRDSAKYTVYLQMNSLKPEDTAVYWCAAKLQIGGRWHNLNDYGYRGQGTQVTVSS

SEQ ID NO: 582 - protein, 122 aa, Artificial
  Nanobody sequence
EVQLVESGGGLVQAGGSLRLSCAASGLTTVYTMAWFRQAPGKEREFVAAITRSGKTTYYADSVKGRFTISRDNAKNTVNLQMNSLKPDDTAVYYCAAKALLGMTNPAGYEYWGQETQVTVSS

SEQ ID NO: 583 - protein, 123 aa, Artificial
  Nanobody sequence
EVQLVEAGGGLVQAGDSLRLSCAASGRTIRGTMAWFRQAPGKDREFVATVTSSGSTTFYADSVKGRFTISRDNAENTVNLQMDSLKPEDTAVYYCAARIRGKVTPSNYDYAYWGQGTQVTVSS

SEQ ID NO: 584 - protein, 122 aa, Artificial
  Nanobody sequence
EVQLVESGGGWMQAGGSLRLSCAASGRTFTMAWFRQASGKEREFVAAITGSGRSTYYTDSVKGRFTISRDNAKNTAYLQMKSLKPEDTAVYYCAGLRGLGLEYDSAKSYSYWGQGTQVTVSS

SEQ ID NO: 585 - protein, 126 aa, Artificial
  Nanobody sequence
  misc_feature (3)..(3): Xaa can be any naturally occurring amino acid
EVXLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 586 - protein, 122 aa, Artificial
  Nanobody sequence
EVQLVESGGGLVQAGGSLRLSCAASGLTSSRYTMSWFRQDPGKEREFVAAVPLSGNTYYADPVRGRFTISRDNAKNTVDLQMNSLKPEDTAVYYCAARASGSIFNRGSYAYWGQGTQVTVSS

SEQ ID NO: 587 - protein, 122 aa, Artificial
  Nanobody sequence
EVQLVESGGGLVPAGGSLRLSCAASGLTDRRYTMSWFRQDPGKEREFVAAVPLSGNTYYADPVRGRFTISRDNAKNTVDLQMNSLKPEDTAVYYCAARASGSIFNRGSYAYWGQGTQVTVSS

SEQ ID NO: 588 - protein, 122 aa, Artificial; identical to SEQ ID NO: 587
  Nanobody sequence

SEQ ID NO: 589 - protein, 126 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATMPATTYLPRSERQYDYWGQGTQVTVSS

SEQ ID NO: 590 - protein, 126 aa, Artificial
  Nanobody sequence
EVQLVESGGGLVQAGGSLTLSCAAAGFTFRRYVMGWFRQAPGKEREFVAAISTGGTWTGYVDSVKDRFTISRDNTKNTVYLQMASLKPEDTAVYNCAATTPTTSYLPRSERQYEYWGQGTQVTVSS

SEQ ID NO: 591 - protein, 126 aa, Artificial
  Nanobody sequence
EVQLVESGGGLVQAGGSLRLSCAAAGCTFRNYVMGWFRQAPGKEREFVTAISTGGTWTGYVDSVKDRFTISRDNTKNTVNLQMASLKPEDTAVYYCAATTPTTSYLPRSERQYEYWGQGTQVTVSS

SEQ ID NO: 592 - protein, 126 aa, Artificial
  Nanobody sequence
EVQLVESGGGLVQAGGSLRLSCAAAGGTFRNYVMGWFRQAPGKEREFVAAISTGGSWTGYVDSVKDRFTISRDNTKNTVYLQMVSLKPEDTAVYYCAATTPATTYLPRSERQYDYWGQGTQVTVSS

SEQ ID NO: 593 - protein, 126 aa, Artificial
  Nanobody sequence
EVQLVESGGGLVQAGGSLRLSCAAAGGTFRNYVMGWFRQAPGKEREFVTAISAGGSWTGYVDSVKDRFTISRDNTKNTVYLQMASLKPEDTAVYYCAATTPATTYLPRSERQYDYWGQGTQVTVSS

SEQ ID NO: 594 - protein, 126 aa, Artificial
  Nanobody sequence
EVQLVESGGGLVQAGGSLRLSCAAAGYTFRAYVMGWFRQAPGKEREFVAGISTGGTWTGYVDSVKDRFTISRDNTKNTVYLQMASLKPEDTAVYYCAATTPVTSYLPRSERQYEHWGQGTQVTVSS

SEQ ID NO: 595 - protein, 128 aa, Artificial
  Nanobody sequence
EVQLVESGGGLVQSGGSLRLSCAAAGYTFRARAYVMGWFRQAPGKEREFVAAISTGGTWTGYVDSVKDRFTISRDNTKNTMYLQMASLKPEDTAVYYCAATTPSTSYLPRSERQYEYWGQGTQVTVSS

SEQ ID NO: 596 - protein, 126 aa, Artificial; identical to SEQ ID NO: 575
  Nanobody sequence

SEQ ID NO: 597 - protein, 126 aa, Artificial
  Nanobody sequence
EVQLVESGGGLVQAGGSLRLSCVASKRTFASYAMGWFRQVPGKERDFVAAITTGSITIYADSVKGRFAISRDNAKNTVYLQMNSLKPEDTAVYYCAAGNREPYLRQYTASNPYDYWGQGTQVTVSS

SEQ ID NO: 598 - protein, 128 aa, Artificial; identical to SEQ ID NO: 576
  Nanobody sequence

SEQ ID NO: 599 - protein, 128 aa, Artificial
  Nanobody sequence
EVQLVESGGGLVQVGDSLRLSCEASGRSRFSTYVMGWFRQAPGKEREFVAAISWSSGNAYYIDSAKGRFATSRDTAKNIMYLQMNSLKPEDTAVYSCAAGRGYGLLSEYTQAARYDYWGQGTQVTVSS

SEQ ID NO: 600 - protein, 127 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 601 - protein, 127 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCAVYRRTYISSTYNESSEYDYWGQGTQVTVSS

SEQ ID NO: 602 - protein, 127 aa, Artificial; identical to SEQ ID NO: 600
  Nanobody sequence

SEQ ID NO: 603 - protein, 127 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISITYSESSDYDYWGQGTQVTVSS

SEQ ID NO: 604 - protein, 127 aa, Artificial
  Nanobody sequence
EVQLVESGGGLVQAGGSLRLSCAASGRTFSISAMGWFRQAPGKEREFVCFITGSGGTTYYGESVKGRFTISRDNAQNPVYLQMNSLKPEDTAVYYCGVYRRTYISSTYSESSEYDYWGQGTQVTVSS

SEQ ID NO: 605 - protein, 127 aa, Artificial; identical to SEQ ID NO: 600
  Nanobody sequence

SEQ ID NO: 606 - protein, 127 aa, Artificial; identical to SEQ ID NO: 600
  Nanobody sequence

SEQ ID NO: 607 - protein, 127 aa, Artificial; identical to SEQ ID NO: 601
  Nanobody sequence

SEQ ID NO: 608 - protein, 127 aa, Artificial; identical to SEQ ID NO: 600
  Nanobody sequence

SEQ ID NO: 609 - protein, 124 aa, Artificial
  Nanobody sequence
EVQLVESGGGLVQAGDSLRLSCAASGRIFTMGWFRQAPGKEREFVAAISGSGSITNYADSVKGRFTISRDYAKTTVFLQMNSLKPEDTAVYYCAAYVRTPYYSSYYDSTKYEYWGQGTQVTVSS

SEQ ID NO: 610 - protein, 124 aa, Artificial
  Nanobody sequence
EVQLVESGGGLVQAGDSLRLSCAASGRTFTMGWFRQAPGKEREFVAFISGSGSVTNYTDSVKGRFTISRDHAKNTVFLQMNSLKPEDTAVYYCAAYLRGPYYSSFYDSTKYEYWGQGTQVTVSS

SEQ ID NO: 611 - protein, 124 aa, Artificial
  Nanobody sequence
EVQLVESGGGLVQAGDSLRLSCAASGRTFTMGWFRRAPGTEREFVASISGSGKITNYADSVKGRFTISRDHAKNAVFLQMDGLKPEDTAVYYCAAYLRSPYYSSYYDSAKYEYWGQGTQVTVSS

SEQ ID NO: 612 - protein, 124 aa, Artificial
  Nanobody sequence
EVQLVESGGGSVQAGDSLRLSCAASGRTFTMGWFRQAPGTEREFVAAISGSGKITNYADSVKGRFTISRDHAMNTVFLQMDSLKPEDTAVYYCAAYLRSPYYSSYYDSAKYEYWGQGTQVTVSS

SEQ ID NO: 613 - protein, 124 aa, Artificial
  Nanobody sequence
EVQLVESGGGLVQAGDSLRLSCAASGRTFTMGWFRQAPGTEREFVAAISGSGKITNYADSVKGRFTISRDHAKNTVFLQMDSLKPEDTAVYYCAAYLRSPYYSSYYDSAKYEYWGQGTQVTVSS

SEQ ID NO: 614 - protein, 124 aa, Artificial; identical to SEQ ID NO: 613
  Nanobody sequence

SEQ ID NO: 615 - protein, 124 aa, Artificial; identical to SEQ ID NO: 613
  Nanobody sequence

SEQ ID NO: 616 - protein, 124 aa, Artificial; identical to SEQ ID NO: 613
  Nanobody sequence

SEQ ID NO: 617 - protein, 124 aa, Artificial; identical to SEQ ID NO: 613
  Nanobody sequence

SEQ ID NO: 618 - protein, 126 aa, Artificial
  Nanobody sequence
EMQLVESGGGLVQAGGSLRLSCVASKRTFASYAMGWFRQVPGKERDFVAAISTHSITVYADSVKGRFTISRDNAKNTVYLQMNTLKPEDTAVYYCAAGNREPYLRQYTASNPYDYWGQGTQVTVSS

SEQ ID NO: 619 - protein, 126 aa, Artificial
  Nanobody sequence
EVQLVESGGGLVQTGGSLRLSCVASRRTFSSYAVGWFRQVPGKERDFVAAISTGSVTIYADSVKGRFTISRDNTKNTVYLQMNSLKPEDTAVYYCAAGNREPYLRQYTASNPYDYWGQGTQVTVSS

SEQ ID NO: 620 - protein, 126 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLHMASLKPEDTAVYYCAATTPVTTYLPRSERQYDYWGQGTQVTVSS

SEQ ID NO: 621 - protein, 126 aa, Artificial
  Nanobody sequence
EVQLVESGGGLVQAGDSLRLSCAAAGFTFRRYVMGWFRQAPGKEREFVAAISTGGTWTGYVDSVKDRFTISRDNTKNTVYLQMASLKPEDTAVYNCAATTPTTSYLPRSERQYEYWGQGTQVTVSS

SEQ ID NO: 622 - protein, 249 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 623 - protein, 251 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 624 - protein, 256 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 625 - protein, 255 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 626 - protein, 255 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 627 - protein, 256 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 628 - protein, 251 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 629 - protein, 253 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 630 - protein, 258 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 631 - protein, 257 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 632 - protein, 257 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 633 - protein, 258 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 634 - protein, 256 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 635 - protein, 258 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 636 - protein, 263 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 637 - protein, 262 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 638 - protein, 262 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 639 - protein, 263 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 640 - protein, 255 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 641 - protein, 257 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 642 - protein, 262 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 643 - protein, 261 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 644 - protein, 261 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 645 - protein, 262 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 646 - protein, 255 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 647 - protein, 257 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 648 - protein, 262 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 649 - protein, 261 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 650 - protein, 261 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 651 - protein, 262 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 652 - protein, 256 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 653 - protein, 258 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 654 - protein, 263 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 655 - protein, 262 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 656 - protein, 262 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 657 - protein, 263 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 658 - protein, 260 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGGSGGGGSGGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 659 - protein, 262 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGGSGGGGSGGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 660 - protein, 267 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGGSGGGGSGGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 661 - protein, 266 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGGSGGGGSGGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 662 - protein, 266 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGGSGGGGSGGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 663 - protein, 267 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGGSGGGGSGGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 664 - protein, 262 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGGSGGGGSGGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 665 - protein, 264 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGGSGGGGSGGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 666 - protein, 269 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGGSGGGGSGGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 667 - protein, 268 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGGSGGGGSGGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 668 - protein, 268 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGGSGGGGSGGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 669 - protein, 269 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGGSGGGGSGGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 670 - protein, 267 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGGSGGGGSGGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 671 - protein, 269 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGGSGGGGSGGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 672 - protein, 274 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGGSGGGGSGGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 673 - protein, 273 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGGSGGGGSGGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 674 - protein, 273 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGGSGGGGSGGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 675 - protein, 274 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGGSGGGGSGGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 676 - protein, 266 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 677 - protein, 268 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 678 - protein, 273 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 679 - protein, 272 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 680 - protein, 272 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 681 - protein, 273 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 682 - protein, 266 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGGSGGGGSGGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 683 - protein, 268 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGGSGGGGSGGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 684 - protein, 273 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGGSGGGGSGGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 685 - protein, 272 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGGSGGGGSGGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 686 - protein, 272 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGGSGGGGSGGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 687 - protein, 273 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGGSGGGGSGGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 688 - protein, 267 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGGSGGGGSGGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 689 - protein, 269 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGGSGGGGSGGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 690 - protein, 274 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGGSGGGGSGGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 691 - protein, 273 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGGSGGGGSGGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 692 - protein, 273 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGGSGGGGSGGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 693 - protein, 274 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGGSGGGGSGGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 694 - protein, 373 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 695 - protein, 375 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 696 - protein, 380 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 697 - protein, 379 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 698 - protein, 379 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 699 - protein, 380 aa, Artificial
  Nanobody sequence
EVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSS

SEQ ID NO: 700 - protein, 375 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 701 - protein, 377 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 702 - protein, 382 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 703 - protein, 381 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 704 - protein, 381 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 705 - protein, 382 aa, Artificial
  Nanobody sequence
EVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSS

SEQ ID NO: 706 - protein, 380 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 707 - protein, 382 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 708 - protein, 387 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 709 - protein, 386 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 710 - protein, 386 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 711 - protein, 387 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSS

SEQ ID NO: 712 - protein, 379 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 713 - protein, 381 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 714 - protein, 386 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 715 - protein, 385 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 716 - protein, 385 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 717 - protein, 386 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSS

SEQ ID NO: 718 - protein, 379 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 719 - protein, 381 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 720 - protein, 386 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 721 - protein, 385 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 722 - protein, 385 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 723 - protein, 386 aa, Artificial
  Nanobody sequence
EVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSS

SEQ ID NO: 724 - protein, 380 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGKLVQAGGSLRLSCAVSGRTSSIYNMAWFRQGPGKGRESVGRIYWSDDNTYYADSVKGRFTISRDNATNTVYLQMNSLKPEDTAVYYCAGKTTKWSLEYDYWGQGTQVTVSS

SEQ ID NO: 725 - protein, 382 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLMQTGGSLRLSCAASGVTYSYYTASWFRQAPGKEREFVAAISPSGNTYYADSVKGRFTISRDNGKHTMYLQMNSLNPEDTAVYFCAIRATDSIYYASSYRHWGQGTQVTVSS

SEQ ID NO: 726 - protein, 387 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 727 - protein, 386 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSS

SEQ ID NO: 728 - protein, 386 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAAAGGTFRNYVMGWFRQAPGKEREFVTAISTGGSWTGYVDSVKDRFTISRDNTKNTVYLQMASLKPEDTAVYYCAATTPATTYLPRSERQYDYWGQGTQVTVSS

SEQ ID NO: 729 - protein, 387 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTHISSTYSESSEYDYWGQGTQVTVSSGGGGSGGGSEVQLVESGGGLVQPGNSLRLSCAASGFTFRSFGMSWVRQAPGKEPEWVSSISGSGSDTLYADSVKGRFTISRDNAKTTLYLQMNSLKPEDTAVYYCTIGGSLSRSSQGTQVTVSSGGGGSGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 730 - protein, 122 aa, Artificial
  Nanobody sequence
EVQLVESGGGLMQTGGSLRLSCAASGVTYSYYTASWFRQAPGKGREFVAAISPSGNTYYADSVKGRFTISRDNGKHTLYLQMNSLRPEDTAVYFCAIRATDSIYYASSYRHWGQGTLVTVSS

SEQ ID NO: 731 - protein, 122 aa, Artificial
  Nanobody sequence
EVQLVESGGGLVQTGGSLRLSCAASGVTYSYYTASWFRQAPGKGREFVAAISPSGNTYYADSVKGRFTISRDNGKHTLYLQMNSLRPEDTAVYFCAIRATDSIYYASSYRHWGQGTLVTVSS

SEQ ID NO: 732 - protein, 122 aa, Artificial
  Nanobody sequence
EVQLVESGGGLMQPGGSLRLSCAASGVTYSYYTASWFRQAPGKGREFVAAISPSGNTYYADSVKGRFTISRDNGKHTLYLQMNSLRPEDTAVYFCAIRATDSIYYASSYRHWGQGTLVTVSS

SEQ ID NO: 733 - protein, 122 aa, Artificial
  Nanobody sequence
EVQLVESGGGLMQTGGSLRLSCAASGVTYSYYTASWFRQAPGKGREFVAAISPSGNTYYADSVKGRFTISRDNSKHTLYLQMNSLRPEDTAVYFCAIRATDSIYYASSYRHWGQGTLVTVSS

SEQ ID NO: 734 - protein, 122 aa, Artificial
  Nanobody sequence
EVQLVESGGGLMQTGGSLRLSCAASGVTYSYYTASWFRQAPGKGREFVAAISPSGNTYYADSVKGRFTISRDNGKNTLYLQMNSLRPEDTAVYFCAIRATDSIYYASSYRHWGQGTLVTVSS

SEQ ID NO: 735 - protein, 122 aa, Artificial; identical to SEQ ID NO: 730
  Nanobody sequence

SEQ ID NO: 736 - protein, 127 aa, Artificial
  Nanobody sequence
EVQLVESGGGLVQPGGSLRLTCAASGRTFRSYAMGWFRQAPGKGREFVAAINYSGGSTNYADSVKGRFTISRDNAKNTLYLQMNSLEPEDTAVYYCAAGSGYASLSYYSTERAYTYWGQGTLVTVSS

SEQ ID NO: 737 - protein, 127 aa, Artificial
  Nanobody sequence
EVQLVESGGGLVQPGGSLRLSCAASGRTFRSYAMGWFRQAPGKGREFVAAINYSGGSTNYADSVKGRFTISRDNAKNTLYLQMNSLEPEDTAVYYCAAGSGYASLSYYSTERAYTYWGQGTLVTVSS

SEQ ID NO: 738 - protein, 127 aa, Artificial
  Nanobody sequence
EVQLVESGGGLVQPGGSLRLTCAASGRTFRSYAMGWFRQAPGKGREFVSAINYSGGSTNYADSVKGRFTISRDNAKNTLYLQMNSLEPEDTAVYYCAAGSGYASLSYYSTERAYTYWGQGTLVTVSS

SEQ ID NO: 739 - protein, 127 aa, Artificial
  Nanobody sequence
EVQLVESGGGLVQPGGSLRLTCAASGRTFRSYAMGWFRQAPGKGREFVAAINYSGGSTNYADSVKGRFTISRDNAKNTLYLQMNSLRPEDTAVYYCAAGSGYASLSYYSTERAYTYWGQGTLVTVSS

SEQ ID NO: 740 - protein, 127 aa, Artificial
  Nanobody sequence
EVQLVESGGGLVQPGGSLRLSCAASGRTFSRSAMGWFRQAPGKGREFVGFITGSGGTTYYGESVKGRFTISRDNAQNPVYLQMNSLRPEDTAVYYCGVYRRTYISSTYSESSEYDYWGQGTLVTVSS

SEQ ID NO: 741 - protein, 127 aa, Artificial
  Nanobody sequence
EVQLVESGGGLVQPGGSLRLSCAASGRTFSRSAMGWFRQAPGKGREFVGFITGSGGTTYYGESVKGRFTISRDNAQNTLYLQMNSLRPEDTAVYYCGVYRRTYISSTYSESSEYDYWGQGTLVTVSS

SEQ ID NO: 742 - protein, 127 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCGVYRRTYISSTYSESSEYDYWGQGTLVTVSS

SEQ ID NO: 743 - protein, 127 aa, Artificial
  Nanobody sequence
EVQLVESGGGLVQPGGSLRLSCAASGFTFSRSAMGWFRQAPGKGREFVGFITGSGGTTYYGESVKGRFTISRDNAQNPVYLQMNSLRPEDTAVYYCGVYRRTYISSTYSESSEYDYWGQGTLVTVSS

SEQ ID NO: 744 - protein, 127 aa, Artificial
  Nanobody sequence
EVQLVESGGGLVQPGGSLRLSCAASGRTFSRSAMGWFRQAPGKGREFVSFITGSGGTTYYGESVKGRFTISRDNAQNPVYLQMNSLRPEDTAVYYCGVYRRTYISSTYSESSEYDYWGQGTLVTVSS

SEQ ID NO: 745 - protein, 127 aa, Artificial
  Nanobody sequence
EVQLVESGGGLVQPGGSLRLSCAASGRTFSRSAMGWFRQAPGKGREFVGFITGSGGTTYYGESVKGRFTISRDNAQNPVYLQMNSLRPEDTAVYYCAVYRRTYISSTYSESSEYDYWGQGTLVTVSS

SEQ ID NO: 746 - protein, 126 aa, Artificial
  Nanobody sequence
EVQLVESGGGLVQPGGSLRLSCAAAGGTFRNYVMGWFRQAPGKGREFVTAISTGGSWTGYVDSVKDRFTISRDNTKNTLYLQMASLRPEDTAVYYCAATTPATTYLPRSERQYDYWGQGTLVTVSS

SEQ ID NO: 747 - protein, 126 aa, Artificial
  Nanobody sequence
EVQLVESGGGLVQPGGSLRLSCAASGGTFRNYVMGWFRQAPGKGREFVTAISTGGSWTGYVDSVKDRFTISRDNTKNTLYLQMASLRPEDTAVYYCAATTPATTYLPRSERQYDYWGQGTLVTVSS

SEQ ID NO: 748 - protein, 126 aa, Artificial
  Nanobody sequence
EVQLVESGGGLVQPGGSLRLSCAAAGGTFRNYVMGWFRQAPGKGREFVTAISTGGSWTGYVDSVKDRFTISRDNSKNTLYLQMASLRPEDTAVYYCAATTPATTYLPRSERQYDYWGQGTLVTVSS

SEQ ID NO: 749 - protein, 126 aa, Artificial
  Nanobody sequence
EVQLVESGGGLVQPGGSLRLSCAAAGGTFRNYVMGWFRQAPGKGREFVTAISTGGSWTGYVDSVKDRFTISRDNTKNTLYLQMNSLRPEDTAVYYCAATTPATTYLPRSERQYDYWGQGTLVTVSS

SEQ ID NO: 750 - protein, 126 aa, Artificial
  Nanobody sequence
EVQLVESGGGLVQPGGSLRLSCAASGRTFRSYPMGWFRQAPGKGREFVASITGSGGSTYYADSVKGRFTISRDNAKNTLYLQMNSLRPEDTAVYSCAAYIRPDTYLSRDYRKYDYWGQGTLVTVSS

SEQ ID NO: 751 - protein, 126 aa, Artificial
  Nanobody sequence
EVQLVESGGGLVQPGGSLRLSCAASGFTFRSYPMGWFRQAPGKGREFVASITGSGGSTYYADSVKGRFTISRDNAKNTLYLQMNSLRPEDTAVYSCAAYIRPDTYLSRDYRKYDYWGQGTLVTVSS

SEQ ID NO: 752 - protein, 126 aa, Artificial
  Nanobody sequence
EVQLVESGGGLVQPGGSLRLSCAASGRTFSSYPMGWFRQAPGKGREFVASITGSGGSTYYADSVKGRFTISRDNAKNTLYLQMNSLRPEDTAVYSCAAYIRPDTYLSRDYRKYDYWGQGTLVTVSS

SEQ ID NO: 753 - protein, 126 aa, Artificial
  Nanobody sequence
EVQLVESGGGLVQPGGSLRLSCAASGRTFRSYPMGWFRQAPGKGREFVSSITGSGGSTYYADSVKGRFTISRDNAKNTLYLQMNSLRPEDTAVYSCAAYIRPDTYLSRDYRKYDYWGQGTLVTVSS

SEQ ID NO: 754 - protein, 126 aa, Artificial
  Nanobody sequence
EVQLVESGGGLVQPGGSLRLSCAASGRTFRSYPMGWFRQAPGKGREFVASITGSGGSTYYADSVKGRFTISRDNAKNTLYLQMNSLRPEDTAVYYCAAYIRPDTYLSRDYRKYDYWGQGTLVTVSS

SEQ ID NO: 755 - protein, 126 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSS

SEQ ID NO: 756 - protein, 126 aa, Artificial
  Nanobody sequence
EVQLVESGGGLVQPGGSLRLSCAASGFTFSSYPMGWFRQAPGKGREFVSSITGSGGSTYYAESVKGRFTISRDNAKNTLYLQMNSLRPEDTAVYYCAAYIRPDTYLSRDYRKYDYWGQGTLVTVSS

SEQ ID NO: 757 - protein, 127 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSS

SEQ ID NO: 758 - protein, 17 aa, Artificial
  Nanobody sequence
SITGSGGSTYYAESVKG

SEQ ID NO: 759 - protein, 385 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSS

SEQ ID NO: 760 - protein, 387 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSS

SEQ ID NO: 761 - protein, 265 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSEVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGC

SEQ ID NO: 762 - protein, 288 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGGSGGGGSGGGGSGGGGSGGGGSEVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGC

SEQ ID NO: 763 - protein, 98 aa, Artificial
  Variable domain sequence
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAR

SEQ ID NO: 764 - protein, 11 aa, Artificial
  FR4 sequence
WGQGTLVTVSS

SEQ ID NO: 765 - protein, 127 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPLYLQMNSLRPEDTAVYYCAVYRRTYISSTYSESSEYDYWGQGTLVTVSS

SEQ ID NO: 766 - protein, 281 aa, Artificial
  Nanobody sequence
EVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVSSGGGGSGGGGSGGGGSGGGGSGGGGSGGGGSEVQLVESGGGLVQAGGSLRLSCAASGRTFRSYPMGWFRQAPGKEREFVASITGSGGSTYYADSVKGRFTISRDNAKNTVYLQMNSLRPEDTAVYSCAAYIRPDTYLSRDYRKYDYWGQGTQVTVS

SEQ ID NO: 767 - protein, 284 aa, Artificial
  Nanobody sequence
EVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSSGGGGSGGGGSGGGGSGGGGSGGGGSGGGGSEVQLVESGGGLVQAGGSLRLSCAASGRTFSRSAMGWFRQAPGKEREFVGFITGSGGTTYYGESVKGRFTISRDNAQNPVYLQMNSLKPEDTAVYYCGVYRRTYISSTYSESSEYDYWGQGTQVTVSS

SEQ ID NO: 768 - protein, 279 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGGSGGGGSGGGGSGGGGSEVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSS

SEQ ID NO: 769 - protein, 284 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGGSGGGGSGGGGSGGGGSGGGGSEVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSS

SEQ ID NO: 770 - protein, 284 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGGSGGGGSGGGGSGGGGSGGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 771 - protein, 269 aa, Artificial
  Nanobody sequence
EVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSSGGGGSGGGGSGGGGSEVQLVESGGGLVQAGGSLRLTCAASGRTFRSYAMGWFRQAPGKEREFVAAINYSGGSTNYADSVKGRFTISRDNAKNTLYLQMNSLEPEDTAVYYCAAGSGYASLSYYSTERAYTYWGQGTQVTVSS

SEQ ID NO: 772 - protein, 846 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSEVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSDAHKSEVAHRFKDLGEENFKALVLIAFAQYLQQCPFEDHVKLVNEVTEFAKTCVADESAENCDKSLHTLFGDKLCTVATLRETYGEMADCCAKQEPERNECFLQHKDDNPNLPRLVRPEVDVMCTAFHDNEETFLKKYLYEIARRHPYFYAPELLFFAKRYKAAFTECCQAADKAACLLPKLDELRDEGKASSAKQRLKCASLQKFGERAFKAWAVARLSQRFPKAEFAEVSKLVTDLTKVHTECCHGDLLECADDRADLAKYICENQDSISSKLKECCEKPLLEKSHCIAEVENDEMPADLPSLAADFVESKDVCKNYAEAKDVFLGMFLYEYARRHPDYSVVLLLRLAKTYETTLEKCCAAADPHECYAKVFDEFKPLVEEPQNLIKQNCELFEQLGEYKFQNALLVRYTKKVPQVSTPTLVEVSRNLGKVGSKCCKHPEAKRMPCAEDYLSVVLNQLCVLHEKTPVSDRVTKCCTESLVNRRPCFSALEVDETYVPKEFNAETFTFHADICTLSEKERQIKKQTALVELVKHKPKATKEQLKAVMDDFAAFVEKCCKADDKETCFAEEGKKLVAASQAALGL

SEQ ID NO: 773 - protein, 869 aa, Artificial [sequence omitted]

SEQ ID NO: 774 - protein, 376 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSGGGGSGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 775 - protein, 376 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSGGGGSGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 776 - protein, 376 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSGGGGSGGGSGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 777 - protein, 348 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 778 - protein, 376 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSGGGGSGGGSGGGSERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 779 - protein, 381 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSGGGGSGGGSGGGGSGGGSGGSCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 780 - protein, 385 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSGGGGSGGGSGGGGSGGGSGGGSGGSCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 781 - protein, 351 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 782 - protein, 377 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGSGGGGSGGGSEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 783 - protein, 377 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGSGGGGSGGGSGGGGSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 784 - protein, 377 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGSGGGGSGGGSGGGGSGGGGSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 785 - protein, 349 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGPFFLYSKLTVDKSRWQQGNVFSCSVMHEALHNHYTQKSLSLSPGK

SEQ ID NO: 786 - protein, 377 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGSGGGGSGGGSGGGSERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 787 - protein, 382 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGSGGGGSGGGSGGGGSGGGSGGSCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 788 - protein, 386 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSGGGGSGGGSGGGGSGGGSGGGGSGGGSGGGSGGSCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 789 - protein, 352 aa, Artificial
  Nanobody sequence
EVQLVESGGGLVQPGGSLRLSCAASGRTFSRSAMGWFRQAPGKGREFVGFITGSGGTTYYADSVKGRFTISRDNAQNPVYLQMNSLRPEDTAVYYCAVYRRTYISSTYSESSEYDYWGQGTLVTVSSCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 790 - protein, 115 aa, Artificial [sequence omitted]

SEQ ID NO: 791 - protein, 115 aa, Artificial [sequence omitted]

SEQ ID NO: 792 - protein, 9 aa, Artificial
  Linker sequence
GGGGSGGGS

SEQ ID NO: 793 - protein, 15 aa, Artificial
  Linker sequence
GGGGSGGGGSGGGGS

SEQ ID NO: 794 - protein, 20 aa, Artificial
  Linker sequence
GGGGSGGGGSGGGGSGGGGS

SEQ ID NO: 795 - protein, 25 aa, Artificial
  Linker sequence
GGGGSGGGGSGGGGSGGGGSGGGGS

SEQ ID NO: 796 - protein, 30 aa, Artificial
  Linker sequence
GGGGSGGGGSGGGGSGGGGSGGGGSGGGGS

SEQ ID NO: 797 - DNA, 30 bp, Artificial
  Primer sequence
cctccctttgacggattccgcgtaatacgt

SEQ ID NO: 798 - DNA, 30 bp, Artificial
  Primer sequence
acgtattacgcggattccgtcaaagggagg

SEQ ID NO: 799 - DNA, 22 bp, Artificial
  Primer sequence
aaggctagagtacttaatacga

SEQ ID NO: 800 - DNA, 21 bp, Artificial
  Primer sequence
cttatcatgtctgctcgaagc

SEQ ID NO: 801 - DNA, 42 bp, Artificial
  Primer sequence
gggaaccagatgggatggaggcggcattaatagtgagatgag

SEQ ID NO: 802 - DNA, 42 bp, Artificial
  Primer sequence
ctcatctcactattaatgccgcctccatcccatctggttccc

SEQ ID NO: 803 - DNA, 46 bp, Artificial
  Primer sequence
ccattagttgaagatactctgtagccacgcttcctgaagtttcatg

SEQ ID NO: 804 - DNA, 46 bp, Artificial
  Primer sequence
catgaaacttcaggaagcgtggctacagagtatcttcaactaatgg

SEQ ID NO: 805 - DNA, 34 bp, Artificial
  Primer sequence
ccattagttgaagatagtctgtaggtaggtctcc

SEQ ID NO: 806 - DNA, 34 bp, Artificial
  Primer sequence
ggagacctacctacagactatcttcaactaatgg

SEQ ID NO: 807 - DNA, 69 bp, Artificial
  Primer sequence
gaagtaggatggacgatgacaaacccgcgaagacttttctggtggcgggagcgaggtgcagctggtgga

SEQ ID NO: 808 - DNA, 51 bp, Artificial
  Primer sequence
gttctatcgggaagacttagaacctccgccgcctgaggagacggtgaccag

SEQ ID NO: 809 - DNA, 44 bp, Artificial
  Primer sequence
gggtatctctcgagaaaagagaggtgcagctggtggagtctggg

SEQ ID NO: 810 - DNA, 70 bp, Artificial
  Primer sequence
tctcttctcctaggtctttgaatctgtgggcgacttcagatttatgagcatctgaggagacggtgaccag

SEQ ID NO: 811 - DNA, 41 bp, Artificial
  Primer sequence
gggtatctctcgagaaaagagaggttcagctagtggaatca

SEQ ID NO: 812 - DNA, 70 bp, Artificial
  Primer sequence
cacctccggatcctccacctccgctacctccacctccactgccacctccacctgaggagacggtgaccag

SEQ ID NO: 813 - DNA, 75 bp, Artificial
  Primer sequence
ggtggaggatccggaggtggaggtagcggaggtggaggctcaggaggtggaggcagtgaggttcagctagtggaa

SEQ ID NO: 814 - DNA, 70 bp, Artificial; identical to SEQ ID NO: 810
  Primer sequence

SEQ ID NO: 815 - protein, 392 aa, Artificial
  Nanobody sequence
DVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSS

SEQ ID NO: 816 - protein, 399 aa, Artificial
  Nanobody sequence
EVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLVTVSSGGGGSGGGSDVQLQASGGGSVQAGGSLRLSCAASGYTIGPYCMGWFRQAPGKEREGVAAINMGGGITYYADSVKGRFTISQDNAKNTVYLLMNSLEPEDTAIYYCAADSTIYASYYECGHGLSTGGYGYDSWGQGTQVTVSSGGGGSGGGSEVQLVESGGGLVQPGGSLRLSCAASGFTFSSYPMGWFRQAPGKGREFVSSITGSGGSTYYADSVKGRFTISRDNAKNTLYLQMNSLRPEDTAVYYCAAYIRPDTYLSRDYRKYDYWGQGTLV

SEQ ID NO: 817 - protein, 4 aa, Artificial
  GLEW sequence
GLEW

SEQ ID NO: 818 - protein, 4 aa, Artificial
  KERE sequence
KERE

SEQ ID NO: 819 - protein, 4 aa, Artificial
  KQRE sequence
KQRE

SEQ ID NO: 820 - protein, 5 aa, Artificial
  KEREL sequence
KEREL

SEQ ID NO: 821 - protein, 5 aa, Artificial
  KEREF sequence
KEREF

SEQ ID NO: 822 - protein, 5 aa, Artificial
  KQREL sequence
KQREL

SEQ ID NO: 823 - protein, 5 aa, Artificial
  KQREF sequence
KQREF

SEQ ID NO: 824 - protein, 5 aa, Artificial
  KEREG sequence
KEREG

SEQ ID NO: 825 - protein, 4 aa, Artificial
  TERE sequence
TERE

SEQ ID NO: 826 - protein, 5 aa, Artificial
  TEREL sequence
TEREL

SEQ ID NO: 827 - protein, 4 aa, Artificial
  KECE sequence
KECE

SEQ ID NO: 828 - protein, 5 aa, Artificial
  KECEL sequence
KECEL

SEQ ID NO: 829 - protein, 5 aa, Artificial
  KECER sequence
KECER

SEQ ID NO: 830 - protein, 4 aa, Artificial
  RERE sequence
RERE

SEQ ID NO: 831 - protein, 5 aa, Artificial
  REREG sequence
REREG

SEQ ID NO: 832 - protein, 4 aa, Artificial
  QERE sequence
QERE

SEQ ID NO: 833 - protein, 5 aa, Artificial
  QEREG sequence
QEREG

SEQ ID NO: 834 - protein, 4 aa, Artificial
  KGRE sequence
KGRE

SEQ ID NO: 835 - protein, 5 aa, Artificial
  KGREG sequence
KGREG

SEQ ID NO: 836 - protein, 4 aa, Artificial
  KDRE sequence
KDRE

SEQ ID NO: 837 - protein, 5 aa, Artificial
  KDREV sequence
KDREV

SEQ ID NO: 838 - protein, 5 aa, Artificial
  DECKL sequence
DECKL

SEQ ID NO: 839 - protein, 5 aa, Artificial
  NVCEL sequence
NVCEL

SEQ ID NO: 840 - protein, 4 aa, Artificial
  GVEW sequence
GVEW

SEQ ID NO: 841 - protein, 4 aa, Artificial
  EPEW sequence
EPEW

SEQ ID NO: 842 - protein, 4 aa, Artificial
  GLER sequence
GLER

SEQ ID NO: 843 - protein, 4 aa, Artificial
  DQEW sequence
DQEW

SEQ ID NO: 844 - protein, 4 aa, Artificial
  DLEW sequence
DLEW

SEQ ID NO: 845 - protein, 4 aa, Artificial
  GIEW sequence
GIEW

SEQ ID NO: 846 - protein, 4 aa, Artificial
  ELEW sequence
ELEW

SEQ ID NO: 847 - protein, 4 aa, Artificial
  GPEW sequence
GPEW

SEQ ID NO: 848 - protein, 4 aa, Artificial
  EWLP sequence
EWLP

SEQ ID NO: 849 - protein, 4 aa, Artificial
  GPER sequence
GPER

SEQ ID NO: 850 - protein, 4 aa, Artificial
  KLEW sequence
KLEW

The invention claimed is:

1. A multivalent polypeptide comprising or essentially consisting of at least two amino acid sequences that can specifically bind to RANK-L, wherein each of the at least two amino acid sequences essentially consists of a VHH, a humanized VHH or a partially humanized VHH, wherein each of the at least two amino acid sequences essentially consists of 4 framework regions (FR1 to FR4, respectively) and 3 complementarity determining regions (CDR1 to CDR3, respectively), wherein the 4 framework regions together are an antibody framework, and in which:
   CDR1 is the amino acid sequence of SEQ ID NO: 200;
   CDR2 is the amino acid sequence of SEQ ID NO: 324; and
   CDR3 is the amino acid sequence of SEQ ID NO: 448.

2. The multivalent polypeptide according to claim 1, wherein the antibody framework of the at least two amino acid sequences
   i) has at least 85% amino acid sequence identity with the antibody framework of a sequence selected from the group consisting of: SEQ ID NOs: 1 to 22; and
   ii) one or more of the amino acid residues at positions 11, 37, 44, 45, 47, 83, 84, 103, 104 and 108 according to Kabat numbering is/are:
      at position 11: L, M, S, V, or W;
      at position 37: F, Y, H, I, L, or V;
      at position 44: G, E, A, D, Q, R, S, or L;
      at position 45: L, R, C, I, L, P, Q, or V;
      at position 47: W, L, F, A, G, I, M, R, S, V, or Y;
      at position 83: R, K, N, E, G, I, M, Q, or T;
      at position 84: P, A, L, R, S, T, D, or V;
      at position 103: W, P, R, or S;
      at position 104: G, or D; and
      at position 108: Q, L, or R.

3. The multivalent polypeptide according to claim 1, wherein the antibody framework of the at least two amino acid sequences
   i) has at least 85% amino acid sequence identity with the antibody framework of SEQ ID NO: 560-621, 730-757 or 765; and
   ii) one or more of the amino acid residues at positions 11, 37, 44, 45, 47, 83, 84, 103, 104 and 108 according to Kabat numbering is/are:
      at position 11: L, M, S, V, or W;
      at position 37: F, Y, H, I, L, or V;
      at position 44: G, E, A, D, Q, R, S, or L;
      at position 45: L, R, C, I, L, P, Q, or V;
      at position 47: W, L, F, A, G, I, M, R, S, V, or Y;
      at position 83: R, K, N, E, G, I, M, Q, or T;
      at position 84: P, A, L, R, S, T, D, or V;
      at position 103: W, P, R, or S;
      at position 104: G, or D; and
      at position 108: Q, L, or R.

4. The multivalent polypeptide according to claim 1, wherein the antibody framework of the at least two amino acid sequences
   i) has at least 85% amino acid sequence identity with the antibody framework of SEQ ID NO: 622-729, 759-762 or 766-773; and
   ii) one or more of the amino acid residues at positions 11, 37, 44, 45, 47, 83, 84, 103, 104 and 108 according to Kabat numbering is/are:
      at position 11: L, M, S, V, or W;
      at position 37: F, Y, H, I, L, or V;
      at position 44: G, E, A, D, Q, R, S, or L;
      at position 45: L, R, C, I, L, P, Q, or V;
      at position 47: W, L, F, A, G, I, M, R, S, V, or Y;
      at position 83: R, K, N, E, G, I, M, Q, or T;
      at position 84: P, A, L, R, S, T, D, or V;
      at position 103: W, P, R, or S;
      at position 104: G, or D; and
      at position 108: Q, L, or R.

5. The multivalent polypeptide according to claim 1, wherein the at least two amino acid sequences are humanized or partially humanized.

6. The multivalent polypeptide according to claim 1 comprising at least two amino acid sequences that are chosen from the group consisting of SEQ ID NOs: 572, 585, and 750-755.

7. The multivalent polypeptide according to claim 1, comprising or essentially consisting of the amino acid sequence of SEQ ID NO: 679, 715, 759, 761, 772, or 766.

8. The multivalent polypeptide according to claim 1, which is a multispecific construct.

9. The multivalent polypeptide according to claim 1, which has one or more additional peptides or protein domains that provide the polypeptide with increased half-life, compared to the corresponding multivalent polypeptide according to claim 1 without the one or more additional peptides or protein domains.

10. The multivalent polypeptide according to claim 9, in which said one or more additional peptides or protein domains that provide the multivalent polypeptide with increased half-life is chosen from the group consisting of serum proteins, an antibody Fc region, and small proteins or peptides that can bind to serum proteins.

11. The multivalent polypeptide according to claim 9, in which said one or more additional peptides or protein domains that provide the multivalent polypeptide with increased half-life is human serum albumin.

12. The multivalent polypeptide according to claim 9, in which said one or more additional peptides or protein domains that provides the multivalent polypeptide with increased half-life is chosen from peptides or protein domains that can bind to one of the following: serum albumin, human serum albumin, a serum immunoglobulin or IgG.

13. The multivalent polypeptide according to claim 9, in which said one or more additional peptides or protein domains that provides the multivalent polypeptide with increased half-life binds to serum albumin, human serum albumin, a serum immunoglobulin, or IgG and is chosen from the group consisting of a VHH, a humanized VHH and a partially humanized VHH.

14. The multivalent polypeptide according to claim 9, in which said one or more additional peptides or protein domains that provides the multivalent polypeptide with increased half-life is chosen from the group consisting of SEQ ID NO's: 790-791.

15. The multivalent polypeptide according to claim 9, that has a serum half-life that is at least 1.5 times greater than the half-life of the corresponding multivalent polypeptide without the one or more additional peptides or protein domains that provide the polypeptide with increased serum half-life.

16. The multivalent polypeptide according to claim 9, that has a serum half-life that is increased more than 1 hour compared to the corresponding multivalent polypeptide without the one or more additional peptides or protein domains that provide the polypeptide with increased serum half-life.

17. The multivalent polypeptide according to claim 9, that has a serum half-life in humans of at least 12 hours.

18. The multivalent polypeptide according to claim 1, comprising or essentially consisting of an amino acid sequence chosen from the group consisting of SEQ ID NO's: 715 and 759.

19. A pharmaceutical composition, comprising at least one multivalent polypeptide according to claim 1 and at least one pharmaceutically acceptable carrier, diluent or excipient, and/or adjuvant.

20. The pharmaceutical composition according to claim 19, further comprising one or more pharmaceutically active polypeptides and/or compounds.

21. A pharmaceutical composition, comprising at least one multivalent polypeptide according to claim 18 and at least one pharmaceutically acceptable carrier, diluent or excipient, and/or adjuvant.

22. The pharmaceutical composition according to claim 21, further comprising one or more pharmaceutically active polypeptides and/or compounds.

\* \* \* \* \*